(12) United States Patent
Dong et al.

(10) Patent No.: US 12,338,293 B2
(45) Date of Patent: Jun. 24, 2025

(54) UPAR ANTIBODIES AND FUSION PROTEINS WITH THE SAME

(71) Applicant: Mural Oncology, Inc., Woburn, MA (US)

(72) Inventors: Jijun Dong, Weston, MA (US); Pinar Gurel, Cambridge, MA (US); Joshua Heiber, Watertown, MA (US); Yuan Hu, Belmont, MA (US)

(73) Assignee: Mural Oncology, Inc., Waltham, MA (US)

(*) Notice: Subject to any disclaimer, the term of this patent is extended or adjusted under 35 U.S.C. 154(b) by 76 days.

(21) Appl. No.: 17/702,329

(22) Filed: Mar. 23, 2022

(65) Prior Publication Data

US 2022/0340678 A1    Oct. 27, 2022

Related U.S. Application Data

(60) Provisional application No. 63/165,313, filed on Mar. 24, 2021.

(51) Int. Cl.
| | | |
|---|---|---|
| *C07K 16/28* | (2006.01) | |
| *A61K 38/00* | (2006.01) | |
| *A61K 39/00* | (2006.01) | |
| *A61P 35/00* | (2006.01) | |
| *C07K 14/54* | (2006.01) | |

(52) U.S. Cl.
CPC .......... *C07K 16/2896* (2013.01); *A61P 35/00* (2018.01); *C07K 14/5434* (2013.01); *A61K 38/00* (2013.01); *A61K 2039/505* (2013.01); *A61K 2039/54* (2013.01); *A61K 2039/545* (2013.01); *C07K 2317/24* (2013.01); *C07K 2317/55* (2013.01); *C07K 2317/565* (2013.01); *C07K 2317/622* (2013.01); *C07K 2317/92* (2013.01); *C07K 2319/30* (2013.01)

(58) Field of Classification Search
CPC ............ C07K 16/2896; C07K 14/5434; C07K 2317/622; C07K 2319/30; A61P 35/00; A61K 38/00; A61K 2039/505
See application file for complete search history.

(56) References Cited

U.S. PATENT DOCUMENTS

| | | | |
|---|---|---|---|
| 3,992,518 A | 11/1976 | Chien et al. | |
| 5,635,599 A | 6/1997 | Pastan et al. | |
| 5,660,848 A | 8/1997 | Moo-Young | |
| 5,756,115 A | 5/1998 | Moo-Young et al. | |
| 5,821,333 A | 10/1998 | Carter et al. | |
| 5,874,104 A | 2/1999 | Adler-Moore et al. | |
| 5,916,588 A | 6/1999 | Popsecu | |
| 6,011,002 A | 1/2000 | Pastan et al. | |
| 6,043,094 A | 3/2000 | Martin et al. | |
| 6,056,973 A | 5/2000 | Allen et al. | |
| 6,126,966 A | 10/2000 | Abra et al. | |
| 6,193,980 B1 | 2/2001 | Efstathiou et al. | |
| 6,316,024 B1 | 11/2001 | Allen et al. | |
| 6,715,485 B1 | 4/2004 | Djupesland | |
| 8,734,774 B2 | 5/2014 | Frelinger et al. | |
| 9,156,897 B2 | 10/2015 | Alvarez et al. | |
| 9,212,230 B2 | 12/2015 | Schuurman et al. | |
| 9,296,801 B2 | 3/2016 | Alvarez et al. | |
| 9,359,415 B2 | 6/2016 | Alvarez et al. | |
| 9,428,563 B2 | 8/2016 | Alvarez | |
| 9,499,634 B2 | 11/2016 | Dixit et al. | |
| 10,023,623 B2 | 7/2018 | Alvarez et al. | |
| 10,183,979 B2 | 1/2019 | Alvarez et al. | |
| 10,407,481 B2 | 9/2019 | Alvarez | |
| 11,945,870 B2 | 4/2024 | Losey et al. | |
| 2004/0002585 A1 | 1/2004 | Holgersson | |
| 2005/0260222 A1 | 11/2005 | Gupta et al. | |
| 2005/0265995 A1 | 12/2005 | Tomlinson et al. | |
| 2005/0287144 A1 | 12/2005 | Wallach et al. | |
| 2007/0264234 A1 | 11/2007 | Sayers et al. | |
| 2008/0152587 A1 | 6/2008 | Zhou et al. | |
| 2008/0286211 A1 | 11/2008 | Barker | |
| 2008/0300193 A1 | 12/2008 | Ahn et al. | |
| 2010/0150945 A1* | 6/2010 | Bigler | A61P 31/12 435/69.6 |
| 2010/0239554 A1 | 9/2010 | Schellenberger | |

(Continued)

FOREIGN PATENT DOCUMENTS

| | | |
|---|---|---|
| JP | 2003513656 | 4/2003 |
| JP | 2003514552 | 4/2003 |

(Continued)

OTHER PUBLICATIONS

Bhattacharya et al., Impact of genetic variation on three dimensional structure and function of proteins, 2017, PLOS One, vol. 12, Issue 3, pp. 1-22 (Year: 2017).*
Fenton et al., Rheostat positions: A new classification of protein positions relevant to pharmacogenomics, 2020, Medicinal Chemistry Research, vol. 29, pp. 1133-1146 (Year: 2020).*
Guo et al., Protein tolerance to random amino acid change, 2004, PNAS, vol. 101, No. 25, pp. 9205-9921 (Year: 2004).*
Sommavilla et al., Expression, engineering and characterization of the tumor-targeting heterodimeric immunocytokine F8-IL12, 2010, Protein Engineering, Design & Selection, vol. 23, No. 8, pp. 653-661 (Year: 2010).*

(Continued)

*Primary Examiner* — Jeffrey Stucker
*Assistant Examiner* — Brittney E Donoghue
(74) *Attorney, Agent, or Firm* — Fish & Richardson P.C.

(57) ABSTRACT

The disclosure provides urokinase plasminogen activator receptor (uPAR) binding polypeptides (e.g., uPAR antigen binding proteins), and fusion proteins comprising said uPAR binding polypeptides and a cytokine or variant thereof. The disclosure further provides pharmaceutical compositions comprising the uPAR binding polypeptides and fusion proteins of the disclosure and methods of treating cancer with the same. The disclosure further provides engineered IL-12 p35 and p40 polypeptides.

15 Claims, 12 Drawing Sheets

Specification includes a Sequence Listing.

(56) References Cited

U.S. PATENT DOCUMENTS

| | | |
|---|---|---|
| 2010/0261872 A1 | 10/2010 | DeFrees et al. |
| 2010/0298236 A1 | 11/2010 | Grotzinger et al. |
| 2011/0112179 A1 | 5/2011 | Airan et al. |
| 2011/0243932 A1 | 10/2011 | Barrett et al. |
| 2012/0028911 A1 | 2/2012 | Shebuski et al. |
| 2013/0040845 A1 | 2/2013 | Springer et al. |
| 2013/0336924 A1 | 12/2013 | Alvarez et al. |
| 2013/0336925 A1 | 12/2013 | Alvarez et al. |
| 2013/0338067 A1 | 12/2013 | Alvarez et al. |
| 2014/0154254 A1 | 6/2014 | Kannan et al. |
| 2014/0234962 A1 | 8/2014 | Alvarez |
| 2015/0307628 A1 | 10/2015 | Kim et al. |
| 2016/0052983 A1 | 2/2016 | Alvarez et al. |
| 2016/0237132 A1 | 8/2016 | Alvarez et al. |
| 2017/0044228 A1 | 2/2017 | Alvarez |
| 2017/0233447 A1 | 8/2017 | Qin |
| 2018/0179273 A1 | 6/2018 | Fog et al. |
| 2018/0264110 A1* | 9/2018 | Yoo ............ A61P 37/04 |
| 2020/0024337 A1* | 1/2020 | Kallunki ........... C07K 16/18 |
| 2020/0040053 A1 | 2/2020 | Alvarez |
| 2020/0317758 A1* | 10/2020 | Torres ............. C07K 16/1271 |

FOREIGN PATENT DOCUMENTS

| | | |
|---|---|---|
| JP | 2004528014 | 9/2004 |
| JP | 2005514442 | 5/2005 |
| JP | 2006517191 | 7/2006 |
| JP | 2008504001 | 2/2008 |
| JP | 2008521489 | 6/2008 |
| JP | 2009512433 | 3/2009 |
| JP | 2010536341 | 12/2010 |
| JP | 6388408 | 9/2018 |
| WO | WO 1995027732 | 10/1995 |
| WO | WO 1999046392 | 9/1999 |
| WO | WO 2001096565 | 12/2001 |
| WO | WO 2002062375 | 8/2002 |
| WO | WO 2003/059376 | 7/2003 |
| WO | WO 2004016740 | 2/2004 |
| WO | WO 2005016950 | 2/2005 |
| WO | WO 2005034863 | 4/2005 |
| WO | WO 2005116077 A2 | 12/2005 |
| WO | WO 2007020889 | 2/2007 |
| WO | WO 2007046006 | 4/2007 |
| WO | WO 2007062844 | 6/2007 |
| WO | WO 2007063907 | 6/2007 |
| WO | WO 2007120693 A2 | 10/2007 |
| WO | WO 2008072075 | 6/2008 |
| WO | WO 2008144757 | 11/2008 |
| WO | WO 2009/002562 | 12/2008 |
| WO | WO 2009153960 | 12/2009 |
| WO | WO 2010020766 | 2/2010 |
| WO | WO 2010091122 | 8/2010 |
| WO | WO 2010127029 | 11/2010 |
| WO | WO 2011100620 A2 | 8/2011 |
| WO | WO 2011103049 | 8/2011 |
| WO | WO 2011123683 | 10/2011 |
| WO | WO 2012016203 | 2/2012 |
| WO | WO 2012/040323 | 3/2012 |
| WO | WO 2012062904 | 5/2012 |
| WO | WO 2013184938 | 12/2013 |
| WO | WO 2013184939 | 12/2013 |
| WO | WO 2015124297 A1 | 8/2015 |
| WO | WO-2017062953 A1 * | 4/2017 ............ A61P 35/00 |
| WO | WO 2019010219 A1 | 1/2019 |
| WO | WO 2019209965 A2 | 10/2019 |
| WO | WO 2020072821 A2 | 4/2020 |

OTHER PUBLICATIONS

Rabbani et al., Urokinase Receptor Antibody Can Reduce Tumor Volume and Detect the Presence of Occult Tumor Metastases in Vivo, 2002, Cancer Research, vol. 62, pp. 2390-2397 (Year: 2002).*

Kontermann et al., Dual targeting strategies with bispecific antibodies, 2012, mAbs, vol. 4, Issue 2, pp. 182-197 (Year: 2012).*

Chen et al., Fusion Protein Linkers: Property, Design and Functionality, 2013, Advanced Drug Delivery, vol. 65, Issue 10, pp. 1357-1369 (Year: 2013).*

Ma et al., Antibody stability: A key to performance—Analysis, influences and improvement, 2020, Biochimie, vol. 177, pp. 213-225 (Year: 2020).*

Sela-Culang et al., The structural basis of antibody-antigen recognition, 2013, Frontiers in Immunology, vol. 4, Article 302, pp. 1-13 (Year: 2013).*

Kussie et al., A Single Engineered Amino Acid Substitution Changes Antibody Fine Specificity, 1994, Journal of Immunology, pp. 146-152 (Year: 1994).*

U.S. Appl. No. 61/657,264, Alvarez et al., filed Jun. 8, 2012.

Al-Lazikani et al., "Standard conformations for the canonical structures of immunoglobulins." Journal of molecular biology, Nov. 7, 1997, 273(4):927-48.

atcc.org [online] "U-937 CRL-1593.2," retrieved from URL<https://www.atcc.org/products/crl-1593.2?matchtype=&network=g&device=c&adposition=&keyword=&gad_source=1&gclid=EAIaIQobChMIoP686uODhQMVUpxaBR28owYDEAAYASAAEgLgUvBwE>, retrieved on Mar. 20, 2024, 7 pages.

Bird et al., "Single-chain antigen-binding proteins," Science, Oct. 21, 1988, 242(4877):423-6.

Cao et al., "Tim-4 inhibition of T-cell activation and T helper type 17 differentiation requires both the immunoglobulin V and mucin domains and occurs via the mitogen-activated protein kinase pathway," Immunology, Jun. 2011, 133(2):179-189.

Carter, "Bispecific human IgG by design." Journal of Immunological methods, Feb. 1, 2001, 248(1-2):7-15.

CAS No. 6132-04-3, "Sodium citrate tribasic dihydrate," Sigma-Aldrich, retrieved on Mar. 22, 2024, retrieved from URL <https://www.sigmaaldrich.com/US/en/substance/294106132043>, 5 pages.

Chaudhary et al., "A rapid method of cloning functional variable-region antibody genes in *Escherichia coli* as single-chain immunotoxins," Proceedings of the National Academy of Sciences, Feb. 1990, 87(3):1066-70.

Chen et al., "Fusion protein linkers: property, design and functionality," Advanced drug delivery reviews, Oct. 15, 2013, 65(10):1357-69.

Cooper et al., "T-cell clones can be rendered specific for CD19: toward the selective augmentation of the graft-versus-B-lineage leukemia effect," Blood, 101(4):1637-1644, 2003.

Edelman "The covalent structure of an entire γG immunoglobulin molecule," Proceedings of the National Academy of Sciences, May 1969, 63(1):78-85.

Fontenot et al., "Human immunodeficiency virus (HIV) antigen: Structure and serology of multivalent human mucin MUC1-HIV V3 chimeric proteins," Proceedings of the National Academy of Sciences, Jan. 1995, 92(1):315-319.

Grassot et al., "RTKdb: database of receptor tyrosine kinase," Nucleic Acids Research, Jan. 2003, 31(1):353-358.

Gunasekaran et al., "Enhancing antibody Fc heterodimer formation through electrostatic steering effects: applications to bispecific molecules and monovalent IgG." Journal of Biological Chemistry, Jun. 18, 2010, 285(25):19637-46.

Heeley et al., "Mutations flanking the polyglutamine repeat in the modulatory domain of rat glucocorticoid receptor lead to an increase in affinity for hormone," Endocrine research, Jan. 2002, 28(3):217-29.

Honegger et al., "Yet another numbering scheme for immunoglobulin variable domains: an automatic modeling and analysis tool," J. Mol. Biol. Jun. 8, 2001; 309(3):657-70.

International Preliminary Report on Patentability in International Appln. No. PCT/US2013/044556, mailed on Nov. 15, 2013, 7 pages.

International Search Report and Written Opinion in International Appln. No. PCT/US2013/044556, mailed on Nov. 15, 2013, 9 pages.

Jones, "Proteinase mutants of Saccharomyces cerevisiae," Genetics, Jan. 1977, 85(1):23-33.

(56) References Cited

OTHER PUBLICATIONS

Karlin et al., "Methods for assessing the statistical significance of molecular sequence features by using general scoring schemes," Proceedings of the National Academy of Sciences, Mar. 1990, 87(6):2264-2268.
Kim et al., "Hybrid restriction enzymes: zinc finger fusions to Fok I cleavage domain," Proceedings of the National Academy of Sciences, Feb. 1996, 93(3):1156-60.
Kingsman et al., "Replication in Saccharomyces cerevisiae of plasmid pBR313 carrying DNA from the yeast trpl region." Gene, Oct. 1979, 7(2):141-52.
Klein et al., "Progress in overcoming the chain association issue in bispecific heterodimeric IgG antibodies." MAbs, Nov. 2012, 4(6):653-663.
Labrijn et al., Efficient generation of stable bispecific IgG1 by controlled Fab-arm exchange. Proceedings of the National Academy of Sciences, Mar. 26, 2013, 110(13):5145-50.
Lefranc et al., "IMGT unique numbering for immunoglobulin and T cell receptor variable domains and Ig superfamily V-like domains," Dev Comp Immunol, 2003, Jan. 27(1):55-77.
Liljeblad et al., "Analysis of agalacto-IgG in rheumatoid arthritis using surface plasmon resonance," Glycoconjugate journal, May 2000, 17:323-9.
Liu et al., "Design of polydactyl zinc-finger proteins for unique addressing within complex genomes," Proceedings of the National Academy of Sciences, May 1997, 94(11):5525-30.
MacCallum et al., "Antibody-antigen interactions: contact analysis and binding site topography," Journal of molecular biology, Oct. 11, 1996, 262(5):732-45.
Merrifield, "Solid Phase Peptide Synthesis. I. The Synthesis of a Tetrapeptide," Journal of the American Chemical Society, Jul. 1963, 85(14):2149-2154.
Mortler et al., "Soluble interleukin-15 receptor α (IL-15Rα)-sushi as a selective and potent agonist of IL-15 action through IL-15Rβ/γ: hyperagonist IL-15. IL-15Rα fusion proteins," Journal of Biological Chemistry, Jan. 20, 2006, 281(3):1612-9.
Muda et al., "Therapeutic assessment of SEED: a new engineered antibody platform designed to generate mono-and bispecific antibodies." Protein Engineering, Design & Selection, May 2011, 24(5):447-54.
Nayeem et al., "A comparative study of available software for high-accuracy homology modeling: From sequence alignments to structural models," Protein Science, Apr. 2006, 15(4):808-824.
Nomellini et al., "S-layer-mediated display of the immunoglobulin G-binding domain of streptococcal protein G on the surface of Caulobacter crescentus: development of an immunoactive reagent," Applied and environmental microbiology, May 15, 2007, 73(10):3245-53.
Puskas et al., "Development of an attenuated interleukin-2 fusion protein that can be activated by tumour-expressed proteases," Immunology, Jun. 2011, 133(2):206-220.
Ridgway et al., "'Knobs-into-holes' engineering of antibody CH3 domains for heavy chain heterodimerization." Protein Engineering, Design and Selection, Jul. 1996, 9(7):617-21.
Scheraga, "Predicting three-dimensional structures of oligopeptides," Reviews in computational chemistry, Jan. 1992, 1:73-142.
Shen, "Deletion of the linker connecting the catalytic and cellulose-binding domains of endoglucanase A (CenA) of Cellulomonas fimi alters its conformation and catalytic activity," Journal of Biological Chemistry, Jun. 1991, 266(17):11335-40.
Shikari et al., "Effect Of Topical IL-IRA on Signs And Symptoms Of Dry Eye Disease In Patients With Ocular Graft-versus-host Disease (GVHD)," Investigative Ophthalmology & Visual Science, Mar. 2012, 53(14):579 (Abstract Only).
Simon et al., "Identification of a Urokinase Receptor-Integrin Interaction Site," J. Biol. Chem., Apr. 2000, 275:10228-34.
Stinchcomb et al., "Isolation and characterisation of a yeast chromosomal replicator," Nature, Nov. 1979, 282(5734):39-43.
Tatusova et al., "BLAST 2 Sequences, a new tool for comparing protein and nucleotide sequences," FEMS Microbiology Letters, Aug. 1999, 177(1):187-188.
Tschemper et al., "Sequence of yeast DNA fragmant containing a chromosomal replicator and the TRP1 gene," 1980, Gene, 10:157-166.
UniProt Accession No. P18510.1, "IL1RA_Human," dated May 8, 2019, 9 pages.
UniProt Accession No. Q8N307, "Mucin-20", dated Nov. 20, 2014, 6 pages.
Van der Pluijm G et al., "Urokinase-receptor/integrin complexes are functionally involved in adhesion and progression of human breast cancer in vivo," The American journal of pathology, Sep. 2001, 159(3):971-82.
Wranik et al., "LUZ-Y, a novel platform for the mammalian cell production of full-length IgG-bispecific antibodies," Journal of Biological Chemistry, Dec. 21, 2012, 287(52):43331-9.
Gonias et al., "Urokinase receptor and resistance to targeted anticancer agents", Frontiers in Pharmacology vol. 6, Article 154 (2015).
International Search Report and Written Opinion for International Application No. PCT/US2022/021522, mailed Aug. 18, 2022, 12 pages.
Leong et al., "Optimized expression and specific activity of IL-12 by directed molecular evolution", PNAS 100(3):1163-1168 (2003).
Lin et al., "Structure-based Engineering of Species Selectivity in the Interaction between Urokinase and Its Receptor", The Journal of Biological Chemistry 285(14):10982-10992 (2010).
Mazar et al., "Development of Novel Therapeutics Targeting the Urokinase Plasminogen Activator Receptor (uPAR) and Their Translation Toward the Clinic", Current Pharmaceutical Design 17(19):1970-1978 (2011).
Venetz et al., "Targeted Reconstitution of Cytokine Activity upon Antigen Binding using Split Cytokine Antibody Fusion Proteins", The Journal of Biological Chemistry 291(35):18139-18147 (2016).
Bouchaud et al., "The Exon-3-Encoded Domain of IL-15Rα Contributes to IL-15 High-Affinity Binding and Is Crucial for the IL-15 Antagonistic Effect of Soluble IL-15Rα," Journal of Molecular Biology, Sep. 2008, 382(1):1-12.
Office Action in Eurasian Appln. No. 202392665, mailed on Sep. 25, 2024, 7 pages (with English translation).
Office Action in Japanese Appln. No. 2023-085990, mailed on Apr. 23, 2024, 6 pages (with English translation).
Rowley et al., "Expression of IL-15RA or an IL-15/IL-15RA fusion on CD81 T cells modifies adoptively transferred T-cell function in cis," European Journal of Immunology, Feb. 2009, 39(2):491-506.
Extended European Search Report in European Appln. No. 22776558.3, mailed on Jan. 21, 2025, 12 pages.

* cited by examiner

*Human scIL-12*

*p35-SA*

*p35 KiH (Fab)*

*p40-ScFv*

*p35-ScFv2*

*p35-KiH (ScFv)*

*p40-Fab*

*p40-IgG*

Tumor and serum pharmacokinetics from PET/CT imaging of radiolabeled tumor-targeted subunits

UPAR ANTIBODIES AND FUSION PROTEINS WITH THE SAME

RELATED APPLICATION

This application claims the benefit of U.S. Provisional Patent Application Ser. No. 63/165,313 filed Mar. 24, 2021, the entire disclosure of which is hereby incorporated herein by reference.

SEQUENCE LISTING

The instant application contains a Sequence Listing which has been submitted electronically in ASCII format and is hereby incorporated by reference in its entirety. Said ASCII copy, created on Jun. 30, 2022, is named 727604_ALW-3084_ST25.txt and is 827,899 bytes in size.

BACKGROUND

Immunotherapy is a rapidly emerging treatment modality for cancer. Immunotherapies fall into the general categories of: (i) immune checkpoint molecule modulators capable of agonizing or antagonizing regulatory molecules as appropriate to enhance a desirable immune response (e.g. agonizing stimulatory immune receptors) or to inhibit an undesirable immune response (e.g. antagonizing inhibitory immune checkpoint molecules); (ii) cytokines, protein molecules that help regulate and direct the immune system; and (iii) cancer vaccines, molecules (or combinations) that generate immunological memory responses to specific antigens/pathogens. While promising immunotherapies are now in the clinic with an encouraging pipeline of new drugs/agents under development, it would be desirable to develop new immunotherapies for use on their own or in combination with other categories of immunotherapy, targeted therapies and conventional cytotoxic therapies.

SUMMARY

In one aspect, the disclosure provides an isolated antigen binding protein that binds specifically to urokinase plasminogen activator receptor (uPAR), comprising:
(a) an antibody heavy chain variable (VH) domain comprising:
  i) an HCDR1 amino acid sequence of GFNIKDEY (SEQ ID NO: 3), GFSLTNYG (SEQ ID NO: 11), GNTFTDYG (SEQ ID NO: 19), GTTFTDYG (SEQ ID NO: 41), or GYTFTSYG (SEQ ID NO: 27);
  ii) an HCDR2 amino acid sequence of IDPENGDT (SEQ ID NO: 4), IWSDGGT (SEQ ID NO: 12), INTNTGEP (SEQ ID NO: 20), or IYPRSGNT (SEQ ID NO: 28); and
  iii) an HCDR3 amino acid sequence of TGGNYVGWFPY (SEQ ID NO: 5), ARGGRSDLFAY (SEQ ID NO: 13), AHYSFDY (SEQ ID NO: 21), or AGKDYGSTYADY (SEQ ID NO: 29); and
(b) an antibody light chain variable (VL) domain comprising:
  iv) an LCDR1 amino acid sequence of SSVSY (SEQ ID NO: 6), QSIVHSNGNTY (SEQ ID NO: 14), ENIYSN (SEQ ID NO: 22), SSVSSRY (SEQ ID NO: 30);
  v) an LCDR2 amino acid sequence of DTS (SEQ ID NO: 7), KVS (SEQ ID NO: 15), AAT (SEQ ID NO: 23), or GTS (SEQ ID NO: 31); and
  vi) an LCDR3 amino acid sequence of QQWSSNPPY (SEQ ID NO: 8), FQGSHVPYT (SEQ ID NO: 16), QHFWGTPWT (SEQ ID NO: 24), QQYHSDPLT (SEQ ID NO: 32).

In certain embodiments, the VH domain comprises an amino acid sequence of SEQ ID NO: 33, SEQ ID NO: 34 SEQ ID NO: 37, SEQ ID NO: 42, or SEQ ID NO: 43, and the VL domain comprises an amino acid sequence of SEQ ID NO: 35, SEQ ID NO: 36, SEQ ID NO: 38, SEQ ID NO: 39, SEQ ID NO: 40, or SEQ ID NO: 44.

In certain embodiments of the antigen binding protein:
a) the VH domain comprises an HCDR1 amino acid sequence of GFNIKDEY (SEQ ID NO: 3), an HCDR2 amino acid sequence of IDPENGDT (SEQ ID NO: 4), an HCDR3 amino acid sequence of TGGNYVGWFPY (SEQ ID NO: 5); and
b) the VL domain comprises an LCDR1 amino acid sequence of SSVSY (SEQ ID NO: 6), an LCDR2 amino acid sequence of DTS (SEQ ID NO: 7), and an LCDR3 amino acid sequence of QQWSSNPPY (SEQ ID NO: 8).

In certain embodiments of the antigen binding protein:
a) the VH domain comprises an HCDR1 amino acid sequence of GFSLTNYG (SEQ ID NO: 11), an HCDR2 amino acid sequence of IWSDGGT (SEQ ID NO: 12), an HCDR3 amino acid sequence of ARGGRSDLFAY (SEQ ID NO: 13); and
b) the VL domain comprises an LCDR1 amino acid sequence of QSIVHSNGNTY (SEQ ID NO: 14), an LCDR2 amino acid sequence of KVS (SEQ ID NO: 15), and an LCDR3 amino acid sequence of FQGSHVPYT (SEQ ID NO: 16).

In certain embodiments of the antigen binding protein:
a) the VH domain comprises an HCDR1 amino acid sequence of GNTFTDYG (SEQ ID NO: 19), or GTTFTDYG (SEQ ID NO: 41), an HCDR2 amino acid sequence of INTNTGEP (SEQ ID NO: 20), an HCDR3 amino acid sequence of AHYSFDY (SEQ ID NO: 21); and
b) the VL domain comprises an LCDR1 amino acid sequence of ENIYSN (SEQ ID NO: 22), an LCDR2 amino acid sequence of AAT (SEQ ID NO: 23), and an LCDR3 amino acid sequence of QHFWGTPWT (SEQ ID NO: 24).

In certain embodiments of the antigen binding protein:
a) the VH domain comprises an HCDR1 amino acid sequence of GYTFTSYG (SEQ ID NO: 27), an HCDR2 amino acid sequence of IYPRSGNT (SEQ ID NO: 28), an HCDR3 amino acid sequence of AGKDYGSTYADY (SEQ ID NO: 29); and
b) the VL domain comprises an LCDR1 amino acid sequence of SSVSSRY (SEQ ID NO: 30), an LCDR2 amino acid sequence of GTS (SEQ ID NO: 31), and an LCDR3 amino acid sequence of QQYHSDPLT (SEQ ID NO: 32).

In certain embodiments of the antigen binding protein:
a) the VH domain comprises an amino acid sequence of SEQ ID NO: 33, and the VL domain comprises an amino acid sequence of SEQ ID NO: 35;
b) the VH domain comprises an amino acid sequence of SEQ ID NO: 33, and the VL domain comprises an amino acid sequence of SEQ ID NO: 36;
c) the VH domain comprises an amino acid sequence of SEQ ID NO: 34, and the VL domain comprises an amino acid sequence of SEQ ID NO: 35;

d) the VH domain comprises an amino acid sequence of SEQ ID NO: 34, and the VL domain comprises an amino acid sequence of SEQ ID NO: 36;
e) the VH domain comprises an amino acid sequence of SEQ ID NO: 37, and the VL domain comprises an amino acid sequence of SEQ ID NO: 38;
f) the VH domain comprises an amino acid sequence of SEQ ID NO: 37, and the VL domain comprises an amino acid sequence of SEQ ID NO: 39;
g) the VH domain comprises an amino acid sequence of SEQ ID NO: 37, and the VL domain comprises an amino acid sequence of SEQ ID NO: 40;
h) the VH domain comprises an amino acid sequence of SEQ ID NO: 42, and the VL domain comprises an amino acid sequence of SEQ ID NO: 44; or
i) the VH domain comprises an amino acid sequence of SEQ ID NO: 43, and the VL domain comprises an amino acid sequence of SEQ ID NO: 44.

In certain embodiments, the VH domain and VL domain are attached with an amino acid linker.

In certain embodiments, the amino acid linker comprises (GGGGS)n (SEQ ID NO: 148), wherein n is an integer between 1 and 5.

In certain embodiments, the amino acid linker comprises the amino acid sequence GGGGSGGGGSGGGGS (SEQ ID NO: 149), GGSGGGGSGGGSGGGGSGGGGSGGGSGG (SEQ ID NO: 150), or GGGSGGGGSG (SEQ ID NO: 246).

In certain embodiments, the antigen binding protein comprises a Fab fragment, a F(ab')2 fragment, an Fd fragment, an Fv fragment, a single chain Fv (scFv), a dAb fragment, a single domain antibody, or a nanobody.

In certain embodiments, the antigen binding protein comprises the amino acid sequence of any one of SEQ ID NOs: 56-71.

In certain embodiments, the antigen binding protein further comprises the amino acid sequence of any one of SEQ ID NOs: 72-78.

In certain embodiments, the antigen binding protein comprises an antibody heavy chain (HC) amino acid sequence of SEQ ID NO: 45, 46, 49, 53, or 54, and an antibody light chain (LC) amino acid sequence of SEQ ID NO: 47, 48, 50, 51, 52, and 55.

In certain embodiments of the antigen binding protein:
a) the antibody HC comprises the amino acid sequence of SEQ ID NO: 45, and the antibody LC comprises the amino acid sequence of SEQ ID NO: 47;
b) the antibody HC comprises the amino acid sequence of SEQ ID NO: 45, and the antibody LC comprises the amino acid sequence of SEQ ID NO: 48;
c) the antibody HC comprises the amino acid sequence of SEQ ID NO: 46, and the antibody LC comprises the amino acid sequence of SEQ ID NO: 47;
d) the antibody HC comprises the amino acid sequence of SEQ ID NO: 46, and the antibody LC comprises the amino acid sequence of SEQ ID NO: 48;
e) the antibody HC comprises the amino acid sequence of SEQ ID NO: 49, and the antibody LC comprises the amino acid sequence of SEQ ID NO: 50;
f) the antibody HC comprises the amino acid sequence of SEQ ID NO: 49, and the antibody LC comprises the amino acid sequence of SEQ ID NO: 51;
g) the antibody HC comprises the amino acid sequence of SEQ ID NO: 49, and the antibody LC comprises the amino acid sequence of SEQ ID NO: 52;
h) the antibody HC comprises the amino acid sequence of SEQ ID NO: 53, and the antibody LC comprises the amino acid sequence of SEQ ID NO: 55; or
i) the antibody HC comprises the amino acid sequence of SEQ ID NO: 54, and the antibody LC comprises the amino acid sequence of SEQ ID NO: 55.

In certain embodiments, the antigen binding protein comprises an amino acid sequence of SEQ ID NO: 189.

In certain embodiments, the antigen binding protein comprises an amino acid sequence of SEQ ID NO: 213.

In certain embodiments, the antigen binding protein comprises: a first polypeptide chain comprising an amino acid sequence of SEQ ID NO: 178; and a second polypeptide chain comprising an amino acid sequence of SEQ ID NO: 159.

In certain embodiments, the antigen binding protein comprises: a first polypeptide chain comprising an amino acid sequence of SEQ ID NO: 193; and a second polypeptide chain comprising an amino acid sequence of SEQ ID NO: 161.

In certain embodiments, the antigen binding protein comprises: a first polypeptide chain comprising an amino acid sequence of SEQ ID NO: 179; and a second polypeptide chain comprising an amino acid sequence of SEQ ID NO: 159.

In certain embodiments, the antigen binding protein comprises: a first polypeptide chain comprising an amino acid sequence of SEQ ID NO: 194; and a second polypeptide chain comprising an amino acid sequence of SEQ ID NO: 162.

In certain embodiments, the antigen binding protein comprises: a first polypeptide chain comprising an amino acid sequence of SEQ ID NO: 238; a second polypeptide chain comprising an amino acid sequence of SEQ ID NO: 159; and a third polypeptide chain comprising an amino acid sequence of SEQ ID NO: 239.

In certain embodiments, the antigen binding protein binds human uPAR with a KD of less than about $5 \times 10^{-8}$ M, less than about $1 \times 10^{-8}$ M, less than about $5 \times 10^{-9}$ M, less than about $1 \times 10^{-9}$ M, less than about $5 \times 10^{-10}$ M, or less than about $1 \times 10^{-10}$ M.

In certain embodiments, the antigen binding protein binds human uPAR in the presence of a uPAR ligand.

In embodiments, the antigen binding protein thereof binds uPAR ligand-bound human uPAR.

In certain embodiments, the antigen binding protein binds human uPAR on human uPAR-expressing cells, thereby producing a fluorescent signal detected with a fluorescently-labelled antibody that binds to the antigen binding protein, with an EC50 value of about 0.1 nM to about 3.0 nM.

In certain embodiments, the antigen binding protein binds human uPAR on human uPAR-expressing cells in the presence of a uPAR ligand.

In certain embodiments, the antigen binding protein binds a human uPAR DII-DIII domain or a human uPAR DIII domain.

In one aspect, the disclosure provides an isolated antigen binding protein thereof that competes for binding with the antigen binding protein recited above.

In another aspect, the disclosure provides an isolated antigen binding protein thereof that binds the same epitope as the antigen binding protein recited above.

In one aspect, the disclosure provides a pharmaceutical composition comprising the antigen binding protein recited above, and a pharmaceutically acceptable carrier or diluent.

In one aspect, the disclosure provides an isolated nucleic acid molecule comprising a polynucleotide sequence that encodes the antigen binding protein recited above.

In one aspect, the disclosure provides an expression vector comprising the polynucleotide sequence recited above.

In one aspect, the disclosure provides a host cell comprising the expression vector recited above.

In another aspect, the disclosure provides a method of producing the antigen binding protein described above, comprising culturing the host cell recited above under conditions to express the antigen binding protein.

In certain embodiment, the method further comprises isolating the antigen binding protein from the host cell.

In one aspect, the disclosure provides a use of an antigen binding protein that binds specifically to uPAR, for treating or preventing a disease or disorder associated with uPAR activity or expression, the use comprising administering a therapeutically effective amount of the pharmaceutical composition recited above to a subject in need of such treatment.

In one aspect, the disclosure provides a method of treating cancer in a patient in need thereof comprising administering to the patient a therapeutically effective amount of the pharmaceutical composition recited above.

In one aspect, the disclosure provides a fusion protein comprising: (i) the antigen binding protein recited above; and (ii) a cytokine or variant thereof.

In certain embodiments of the fusion protein, the antigen binding protein and the cytokine or variant thereof are linked with an amino acid linker.

In certain embodiments of the fusion protein, the cytokine or variant thereof is selected from the group consisting of IL-2, circularly permuted IL-2 (cpIL-2), IL-15, circularly permuted IL15 (cpIL-15), IL-6, circularly permuted IL-6 (cpIL-6), IL-10, or IL-12.

In certain embodiments of the fusion protein, the cytokine or variant thereof comprises at least one interleukin-12 (IL-12) subunit.

In certain embodiments of the fusion protein, the IL-12 subunit comprises one or both of p35 and p40.

In certain embodiments of the fusion protein, the p35 comprises one or more amino acid substitutions at positions M12, S27, N28, Q35, F39, S44, C74, M111, V114, M119, M145, F150, L161, and D188 of SEQ ID NO: 81.

In certain embodiments of the fusion protein, the amino acid substitution comprises M12S; S27D; N28R; Q35E; F39D or F39H; S44K; C74K, C74D, C74W, C74Y, or C74Q; M111F or M111W; V114I; M119L; M145L; F150Y; L161D or L161Q; D188N; or a combination thereof.

In certain embodiments of the fusion protein, the amino acid substitution comprises N28R and Q35E.

In certain embodiments of the fusion protein, the amino acid substitution comprises S27D and D188N.

In certain embodiments of the fusion protein, the amino acid substitution comprises C74K.

In certain embodiments of the fusion protein, the amino acid substitution comprises S27D, C74K, and D188N.

In certain embodiments of the fusion protein, the p35 comprises an amino acid sequence of SEQ ID NO: 81, SEQ ID NO: 82, or SEQ ID NO: 83.

In certain embodiments of the fusion protein, the p40 comprises one or more amino acid substitution at positions C177 and C252 of SEQ ID NO: 84.

In certain embodiments of the fusion protein, the C177 amino acid substitution is selected from the group consisting of C177S, C177F, C177M, C177H, C177I, or C177Q.

In certain embodiments of the fusion protein, the C252 amino acid substitution is C252S.

In certain embodiments of the fusion protein, the p40 comprises an amino acid sequence of SEQ ID NO: 84, SEQ ID NO: 85, SEQ ID NO: 86, or SEQ ID NO: 87.

In certain embodiments of the fusion protein, the cytokine or variant thereof comprises a single-chain IL-12 (scIL-12) comprising a p35 and a p40 subunit attached by an amino acid linker.

In certain embodiments of the fusion protein, the amino acid linker comprises the sequence GGSGGGGSGG (SEQ ID NO: 156).

In certain embodiments of the fusion protein, the scIL-12 comprises an amino acid sequence of SEQ ID NO: 88 or SEQ ID NO: 89.

In one aspect, the disclosure provides a pharmaceutical composition comprising the fusion protein recited above, and a pharmaceutically acceptable carrier or diluent.

In one aspect, the disclosure provides an isolated nucleic acid molecule comprising a polynucleotide sequence that encodes the fusion protein recited above.

In one aspect, the disclosure provides an expression vector comprising the polynucleotide sequence recited above.

In one aspect, the disclosure provides a host cell comprising the expression vector recited above.

In another aspect, the disclosure provides a method of producing the fusion protein recited above, comprising culturing the host cell recited above under conditions to express the fusion protein.

In certain embodiments, the method further comprises isolating the fusion protein from the host cell.

In one aspect, the disclosure provides a use of fusion protein that binds specifically to uPAR, for treating or preventing a disease or disorder associated with uPAR activity or expression, the use comprising administering a therapeutically effective amount of the pharmaceutical composition recited above or the fusion protein recited above to a subject in need of such treatment.

In one aspect, the disclosure provides a method of treating cancer in a patient in need thereof comprising administering to the patient a therapeutically effective amount of the pharmaceutical composition recited above or the fusion protein recited above.

In certain embodiments, the pharmaceutical composition or fusion protein is administered simultaneously with a cytokine or variant thereof or a second fusion protein, wherein the second fusion protein comprises a different cytokine or variant thereof from the first fusion protein.

In certain embodiments, the pharmaceutical composition or fusion protein is administered sequentially a cytokine or variant thereof or a second fusion protein, wherein the second fusion protein comprises a different cytokine or variant thereof from the first fusion protein.

In certain embodiments, the cytokine or variant thereof comprises a IL-12 p35 subunit or an IL-12 p40 subunit.

In certain embodiments, the fusion protein clearance rate in a tumor of the patient is slower than the fusion protein clearance rate in serum of the patient.

In one aspect, the disclosure provides a method of treating cancer in a patient in need thereof comprising administering to the patient a therapeutically effective amount of a fusion protein and a non-fusion IL-12 subunit, wherein:
(a) the fusion protein comprises:
  (i) an antigen binding protein that binds specifically to urokinase plasminogen activator receptor (uPAR); and
  (ii) a IL-12 p35 subunit or variant thereof, or a IL-12 p40 subunit or variant thereof; and
(b) the non-fusion IL-12 subunit comprising a IL-12 p35 subunit or variant thereof, or a IL-12 p40 subunit or variant thereof, wherein when the fusion protein comprises a IL-12 p35 subunit or variant thereof, the non-fusion IL-12 subunit comprises a IL-12 p40 subunit or variant thereof, and when the fusion protein comprises a IL-12 p40 subunit or variant thereof, the non-fusion IL-12 subunit comprises a IL-12 p35 subunit or variant thereof.

In certain embodiments, the fusion protein and non-fusion IL-12 subunit are administered sequentially.

In certain embodiments, one or both of the fusion protein and non-fusion IL-12 subunit are administered intravenously.

In certain embodiments, the fusion protein is administered first, followed by administering the non-fusion IL-12 subunit after a sufficient amount of time has elapsed for the fusion protein to accumulate in a tumor of the patient.

In certain embodiments, the fusion protein is administered first, followed by administering the non-fusion IL-12 subunit after a sufficient amount of time has elapsed for the fusion protein concentration to substantially reduce in serum of the patient.

In one aspect, the disclosure provides a method of treating cancer in a patient in need thereof comprising administering to the patient a therapeutically effective amount of a first fusion protein and a second fusion protein, wherein:
  (a) the first fusion protein comprises:
    (i) an antigen binding protein that binds specifically to a first epitope on urokinase plasminogen activator receptor (uPAR); and
    (ii) an IL-12 p35 subunit or variant thereof; and
  (b) the second fusion protein comprises:
    (i) an antigen binding protein that binds specifically to a second epitope on uPAR; and
    (ii) am IL-12 p40 subunit or variant thereof.

In certain embodiments, the first epitope and second epitope are the same.

In certain embodiments, the first epitope and second epitope are different.

In certain embodiments, the first fusion protein and second fusion protein are administered sequentially.

In certain embodiments, one or both of the first fusion protein and second fusion protein are administered intravenously.

In certain embodiments, the first fusion protein is administered first, followed by administering the second fusion protein after a sufficient amount of time has elapsed for the first fusion protein to accumulate in a tumor of the patient.

In certain embodiments, the first fusion protein is administered first, followed by administering the second fusion protein after a sufficient amount of time has elapsed for the first fusion protein concentration to substantially reduce in serum of the patient.

In certain embodiments, the second fusion protein is administered first, followed by administering the first fusion protein after a sufficient amount of time has elapsed for the second fusion protein to accumulate in a tumor of the patient.

In certain embodiments, the second fusion protein is administered first, followed by administering the first fusion protein after a sufficient amount of time has elapsed for the second fusion protein concentration to substantially reduce in serum of the patient.

In certain embodiments, one or both of the first fusion protein and second fusion protein comprise an antigen binding protein comprising:
  a) a VH domain comprising an HCDR1 amino acid sequence of GFNIKDEY (SEQ ID NO: 3), an HCDR2 amino acid sequence of IDPENGDT (SEQ ID NO: 4), an HCDR3 amino acid sequence of TGGNYVGWFPY (SEQ ID NO: 5); and
  b) a VL domain comprising an LCDR1 amino acid sequence of SSVSY (SEQ ID NO: 6), an LCDR2 amino acid sequence of DTS (SEQ ID NO: 7), and an LCDR3 amino acid sequence of QQWSSNPPY (SEQ ID NO: 8).

In certain embodiments, one or both of the first fusion protein and second fusion protein comprise an antigen binding protein comprising:
  a) a VH domain comprising an HCDR1 amino acid sequence of GNTFTDYG (SEQ ID NO: 19), or GTTFTDYG (SEQ ID NO: 41), an HCDR2 amino acid sequence of INTNTGEP (SEQ ID NO: 20), an HCDR3 amino acid sequence of AHYSFDY (SEQ ID NO: 21); and
  b) a VL domain comprising an LCDR1 amino acid sequence of ENIYSN (SEQ ID NO: 22), an LCDR2 amino acid sequence of AAT (SEQ ID NO: 23), and an LCDR3 amino acid sequence of QHFWGTPWT (SEQ ID NO: 24).

In certain embodiments, one or both of the first fusion protein and second fusion protein comprise an antigen binding protein comprising:
  a) a VH domain comprising an HCDR1 amino acid sequence of GYTFTSYG (SEQ ID NO: 27), an HCDR2 amino acid sequence of IYPRSGNT (SEQ ID NO: 28), an HCDR3 amino acid sequence of AGKDYGSTYADY (SEQ ID NO: 29); and
  b) a VL domain comprising an LCDR1 amino acid sequence of SSVSSRY (SEQ ID NO: 30), an LCDR2 amino acid sequence of GTS (SEQ ID NO: 31), and an LCDR3 amino acid sequence of QQYHSDPLT (SEQ ID NO: 32).

In one aspect, the disclosure provides a combination comprising a first fusion protein and a second fusion protein, wherein:
  (a) the first fusion protein comprises:
    (i) an antigen binding protein that binds specifically to a first epitope on urokinase plasminogen activator receptor (uPAR); and
    (ii) a IL-12 p35 subunit or variant thereof; and
  (b) the second fusion protein comprises:
    (i) an antigen binding protein that binds specifically to a second epitope on uPAR; and
    (ii) a IL-12 p40 subunit or variant thereof.

In certain embodiments, the first epitope and second epitope are the same.

In certain embodiments, the first epitope and second epitope are different.

In one aspect, the disclosure provides a fusion protein comprising: (i) an antigen binding protein that binds specifically to urokinase plasminogen activator receptor (uPAR); and (ii) a cytokine or variant thereof.

In certain embodiments, the antigen binding protein and the cytokine or variant thereof are linked with an amino acid linker.

In certain embodiments, the cytokine or variant thereof is selected from the group consisting of IL-2, circularly permuted IL-2 (cpIL-2), IL-15, circularly permuted IL15 (cpIL-15), IL-6, circularly permuted IL-6 (cpIL-6), IL-10, or IL-12.

In certain embodiments, the cytokine or variant thereof comprises at least one interleukin-12 (IL-12) subunit.

In certain embodiments, the IL-12 subunit comprises one or both of p35 and p40.

In certain embodiments, the p35 comprises one or more amino acid substitutions at positions M12, S27, N28, Q35, F39, S44, C74, M111, V114, M119, M145, F150, L161, and D188 of SEQ ID NO: 81.

In certain embodiments, the amino acid substitution comprises M12S; S27D; N28R; Q35E; F39D or F39H; S44K; C74K, C74D, C74W, C74Y, or C74Q; M111F or M111W; V114I; M119L; M145L; F150Y; L161D or L161Q; D188N; or a combination thereof.

In certain embodiments, the amino acid substitution comprises N28R and Q35E.

In certain embodiments, the amino acid substitution comprises S27D and D188N.

In certain embodiments, the amino acid substitution comprises C74K.

In certain embodiments, the amino acid substitution comprises S27D, C74K, and D188N.

In certain embodiments, the p35 comprises an amino acid sequence of SEQ ID NO: 81, SEQ ID NO: 82, or SEQ ID NO: 83.

In certain embodiments, the p40 comprises one or more amino acid substitution at positions C177 and C252 of SEQ ID NO: 84.

In certain embodiments, the C177 amino acid substitution is selected from the group consisting of C177S, C177F, C177M, C177H, C177I, or C177Q.

In certain embodiments, the C252 amino acid substitution is C252S.

In certain embodiments, the p40 comprises an amino acid sequence of SEQ ID NO: 84, SEQ ID NO: 85, SEQ ID NO: 86, or SEQ ID NO: 87.

In certain embodiments, the cytokine or variant thereof comprises a single-chain IL-12 (scIL-12) comprising a p35 and a p40 subunit attached by an amino acid linker.

In certain embodiments, the amino acid linker comprises the sequence GGSGGGGSGG (SEQ ID NO: 156).

In certain embodiments, the scIL-12 comprises an amino acid sequence of SEQ ID NO: 88 or SEQ ID NO: 89.

In certain embodiments, the antigen binding protein comprises:
  (a) an antibody heavy chain variable (VH) domain comprising:
  i) an HCDR1 amino acid sequence of GFNIKDEY (SEQ ID NO: 3), GFSLTNYG (SEQ ID NO: 11), GNTFTDYG (SEQ ID NO: 19), GTTFTDYG (SEQ ID NO: 41), or GYTFTSYG (SEQ ID NO: 27);
  ii) an HCDR2 amino acid sequence of IDPENGDT (SEQ ID NO: 4), IWSDGGT (SEQ ID NO: 12), INTNTGEP (SEQ ID NO: 20), or IYPRSGNT (SEQ ID NO: 28); and
  iii) an HCDR3 amino acid sequence of TGGNYVGWFPY (SEQ ID NO: 5), ARGGRSDLFAY (SEQ ID NO: 13), AHYSFDY (SEQ ID NO: 21), or AGKDYGSTYADY (SEQ ID NO: 29); and
  (b) an antibody light chain variable (VL) domain comprising:
  iv) an LCDR1 amino acid sequence of SSVSY (SEQ ID NO: 6), QSIVHSNGNTY (SEQ ID NO: 14), ENIYSN (SEQ ID NO: 22), SSVSSRY (SEQ ID NO: 30);
  v) an LCDR2 amino acid sequence of DTS (SEQ ID NO: 7), KVS (SEQ ID NO: 15), AAT (SEQ ID NO: 23), or GTS (SEQ ID NO: 31); and
  vi) an LCDR3 amino acid sequence of QQWSSNPPY (SEQ ID NO: 8), FQGSHVPYT (SEQ ID NO: 16), QHFWGTPWT (SEQ ID NO: 24), QQYHSDPLT (SEQ ID NO: 32).

In certain embodiments, the VH domain comprises an amino acid sequence of SEQ ID NO: 33, SEQ ID NO: 34 SEQ ID NO: 37, SEQ ID NO: 42, or SEQ ID NO: 43, and the VL domain comprises an amino acid sequence of SEQ ID NO: 35, SEQ ID NO: 36, SEQ ID NO: 38, SEQ ID NO: 39, SEQ ID NO: 40, or SEQ ID NO: 44.

In certain embodiments of the fusion protein:
  a) the VH domain comprises an HCDR1 amino acid sequence of GFNIKDEY (SEQ ID NO: 3), an HCDR2 amino acid sequence of IDPENGDT (SEQ ID NO: 4), an HCDR3 amino acid sequence of TGGNYVGWFPY (SEQ ID NO: 5); and
  b) the VL domain comprises an LCDR1 amino acid sequence of SSVSY (SEQ ID NO: 6), an LCDR2 amino acid sequence of DTS (SEQ ID NO: 7), and an LCDR3 amino acid sequence of QQWSSNPPY (SEQ ID NO: 8).

In certain embodiments of the fusion protein:
  a) the VH domain comprises an HCDR1 amino acid sequence of GFSLTNYG (SEQ ID NO: 11), an HCDR2 amino acid sequence of IWSDGGT (SEQ ID NO: 12), an HCDR3 amino acid sequence of ARGGRSDLFAY (SEQ ID NO: 13); and
  b) the VL domain comprises an LCDR1 amino acid sequence of QSIVHSNGNTY (SEQ ID NO: 14), an LCDR2 amino acid sequence of KVS (SEQ ID NO: 15), and an LCDR3 amino acid sequence of FQGSHVPYT (SEQ ID NO: 16).

In certain embodiments of the fusion protein:
  a) the VH domain comprises an HCDR1 amino acid sequence of GNTFTDYG (SEQ ID NO: 19), or GTTFTDYG (SEQ ID NO: 41), an HCDR2 amino acid sequence of INTNTGEP (SEQ ID NO: 20), an HCDR3 amino acid sequence of AHYSFDY (SEQ ID NO: 21); and
  b) the VL domain comprises an LCDR1 amino acid sequence of ENIYSN (SEQ ID NO: 22), an LCDR2 amino acid sequence of AAT (SEQ ID NO: 23), and an LCDR3 amino acid sequence of QHFWGTPWT (SEQ ID NO: 24).

In certain embodiments of the fusion protein:
  a) the VH domain comprises an HCDR1 amino acid sequence of GYTFTSYG (SEQ ID NO: 27), an HCDR2 amino acid sequence of IYPRSGNT (SEQ ID NO: 28), an HCDR3 amino acid sequence of AGKDYGSTYADY (SEQ ID NO: 29); and
  b) the VL domain comprises an LCDR1 amino acid sequence of SSVSSRY (SEQ ID NO: 30), an LCDR2 amino acid sequence of GTS (SEQ ID NO: 31), and an LCDR3 amino acid sequence of QQYHSDPLT (SEQ ID NO: 32).

In certain embodiments of the fusion protein:
  a) the VH domain comprises an amino acid sequence of SEQ ID NO: 33, and the VL domain comprises an amino acid sequence of SEQ ID NO: 35;
  b) the VH domain comprises an amino acid sequence of SEQ ID NO: 33, and the VL domain comprises an amino acid sequence of SEQ ID NO: 36;
  c) the VH domain comprises an amino acid sequence of SEQ ID NO: 34, and the VL domain comprises an amino acid sequence of SEQ ID NO: 35;
  d) the VH domain comprises an amino acid sequence of SEQ ID NO: 34, and the VL domain comprises an amino acid sequence of SEQ ID NO: 36;
  e) the VH domain comprises an amino acid sequence of SEQ ID NO: 37, and the VL domain comprises an amino acid sequence of SEQ ID NO: 38;

f) the VH domain comprises an amino acid sequence of SEQ ID NO: 37, and the VL domain comprises an amino acid sequence of SEQ ID NO: 39;

g) the VH domain comprises an amino acid sequence of SEQ ID NO: 37, and the VL domain comprises an amino acid sequence of SEQ ID NO: 40;

h) the VH domain comprises an amino acid sequence of SEQ ID NO: 42, and the VL domain comprises an amino acid sequence of SEQ ID NO: 44; or i) the VH domain comprises an amino acid sequence of SEQ ID NO: 43, and the VL domain comprises an amino acid sequence of SEQ ID NO: 44.

In certain embodiments, the VH domain and VL domain are attached with an amino acid linker.

In certain embodiments, the amino acid linker comprises (GGGGS)n (SEQ ID NO: 148), wherein n is an integer between 1 and 5.

In certain embodiments, the amino acid linker comprises the amino acid sequence GGGGSGGGGSGGGGS (SEQ ID NO: 149), GGSGGGGSGGGSGGGGSGGGGSGGGSGG (SEQ ID NO: 150), or GGGSGGGGSG (SEQ ID NO: 246).

In certain embodiments, the antigen binding protein comprises a Fab fragment, a F(ab')2 fragment, an Fd fragment, an Fv fragment, a single chain Fv (scFv), a dAb fragment, a single domain antibody, or a nanobody.

In certain embodiments, the antigen binding protein comprises the amino acid sequence of any one of SEQ ID NOs: 56-71.

In certain embodiments, the antigen binding protein further comprises the amino acid sequence of any one of SEQ ID NOs: 72-78.

In certain embodiments, the fusion protein comprises an antibody heavy chain (HC) amino acid sequence of SEQ ID NO: 45, 46, 49, 53, or 54, and an antibody light chain (LC) amino acid sequence of SEQ ID NO: 47, 48, 50, 51, 52, and 55.

In certain embodiments of the fusion protein:
a) the antibody HC comprises the amino acid sequence of SEQ ID NO: 45, and the antibody LC comprises the amino acid sequence of SEQ ID NO: 47;
b) the antibody HC comprises the amino acid sequence of SEQ ID NO: 45, and the antibody LC comprises the amino acid sequence of SEQ ID NO: 48;
c) the antibody HC comprises the amino acid sequence of SEQ ID NO: 46, and the antibody LC comprises the amino acid sequence of SEQ ID NO: 47;
d) the antibody HC comprises the amino acid sequence of SEQ ID NO: 46, and the antibody LC comprises the amino acid sequence of SEQ ID NO: 48;
e) the antibody HC comprises the amino acid sequence of SEQ ID NO: 49, and the antibody LC comprises the amino acid sequence of SEQ ID NO: 50;
f) the antibody HC comprises the amino acid sequence of SEQ ID NO: 49, and the antibody LC comprises the amino acid sequence of SEQ ID NO: 51;
g) the antibody HC comprises the amino acid sequence of SEQ ID NO: 49, and the antibody LC comprises the amino acid sequence of SEQ ID NO: 52;
h) the antibody HC comprises the amino acid sequence of SEQ ID NO: 53, and the antibody LC comprises the amino acid sequence of SEQ ID NO: 55; or
i) the antibody HC comprises the amino acid sequence of SEQ ID NO: 54, and the antibody LC comprises the amino acid sequence of SEQ ID NO: 55.

In certain embodiments, the fusion protein comprises an amino acid sequence of SEQ ID NO: 189.

In certain embodiments, the fusion protein comprises an amino acid sequence of SEQ ID NO: 213.

In certain embodiments, the fusion protein comprises: a first polypeptide chain comprising an amino acid sequence of SEQ ID NO: 178; and a second polypeptide chain comprising an amino acid sequence of SEQ ID NO: 159.

In certain embodiments, the fusion protein comprises: a first polypeptide chain comprising an amino acid sequence of SEQ ID NO: 193; and a second polypeptide chain comprising an amino acid sequence of SEQ ID NO: 161.

In certain embodiments, the fusion protein comprises: a first polypeptide chain comprising an amino acid sequence of SEQ ID NO: 179; and a second polypeptide chain comprising an amino acid sequence of SEQ ID NO: 159.

In certain embodiments, the fusion protein comprises: a first polypeptide chain comprising an amino acid sequence of SEQ ID NO: 194; and a second polypeptide chain comprising an amino acid sequence of SEQ ID NO: 162.

In certain embodiments, the fusion protein comprises: a first polypeptide chain comprising an amino acid sequence of SEQ ID NO: 238; a second polypeptide chain comprising an amino acid sequence of SEQ ID NO: 159; and a third polypeptide chain comprising an amino acid sequence of SEQ ID NO: 239.

In certain embodiments, the antigen binding protein binds human uPAR with a KD of less than about $5 \times 10^{-8}$ M, less than about $1 \times 10^{-8}$ M, less than about $5 \times 10^{-9}$ M, less than about $1 \times 10^{-9}$ M, less than about $5 \times 10^{-10}$ M, or less than about $1 \times 10^{-10}$ M.

In certain embodiments, the antigen binding protein binds human uPAR in the presence of a uPAR ligand.

In certain embodiments, the antigen binding protein binds uPAR ligand-bound human uPAR.

In certain embodiments, the antigen binding protein binds human uPAR on human uPAR-expressing cells, thereby producing a fluorescent signal detected with a fluorescently-labelled antibody that binds to the antibody or fragment thereof, with an EC50 value of about 0.1 nM to about 3.0 nM.

In certain embodiments, the antigen binding protein binds human uPAR on human uPAR-expressing cells in the presence of a uPAR ligand.

In certain embodiments, the antigen binding protein binds a human uPAR DII-DIII domain or a human uPAR DIII domain.

In one aspect, the disclosure provides an engineered IL-12 p35 polypeptide, comprising one or more amino acid substitutions at positions S27, N28, Q35, F39, S44, C74, M111, V114, M119, M145, F150, and L161 of SEQ ID NO: 81.

In certain embodiments, the engineered IL-12 p35 polypeptide further comprises one or both of a S27 and D188 amino acid substitution.

In certain embodiments, the amino acid substitution comprises M12S; S27D; N28R; Q35E; F39D or F39H; S44K; C74K, C74D, C74W, C74Y, or C74Q; M111F or M111W; V114I; M119L; M145L; F150Y; L161D or L161Q; D188N; or a combination thereof.

In certain embodiments, the amino acid substitution comprises N28R and Q35E.

In certain embodiments, the amino acid substitution comprises C74K.

In certain embodiments, the amino acid substitution comprises S27D, C74K, and D188N.

In certain embodiments, the engineered IL-12 p35 polypeptide comprises an amino acid sequence of SEQ ID NO: 81, SEQ ID NO: 82, or SEQ ID NO: 83.

In another aspect, the disclosure provides a fusion protein comprising: (i) the engineered IL-12 p35 polypeptide recited above; and (ii) one or more fusion partners.

In certain embodiments, the one or more fusion partners comprise a moiety that reduces aggregation of the engineered IL-12 p35 polypeptide.

In certain embodiments, the one or more fusion partners comprise a moiety that increases expression of the engineered IL-12 p35 polypeptide.

In certain embodiments, the one or more fusion partners comprise a moiety that increases serum half-life of the engineered IL-12 p35 polypeptide.

In certain embodiments, the one or more fusion partners comprise a targeting moiety.

In certain embodiments, the one or more fusion partners comprise a serum albumin, polyethylene glycol (PEG), or an antigen binding protein.

In certain embodiments, the antigen binding protein binds specifically to urokinase plasminogen activator receptor (uPAR).

In one aspect, the disclosure provides an engineered IL-12 p40 polypeptide, comprising one or more amino acid substitutions at positions C177 and C252 of SEQ ID NO: 84.

In certain embodiments, the C177 amino acid substitution is selected from the group consisting of C177S, C177F, C177M, C177H, C177I, or C177Q.

In certain embodiments, the C252 amino acid substitution is C252S.

In certain embodiments, the p40 comprises an amino acid sequence of SEQ ID NO: 84, SEQ ID NO: 85, SEQ ID NO: 86, or SEQ ID NO: 87.

In another aspect, the disclosure provides a fusion protein comprising: (i) the engineered IL-12 p40 polypeptide recited above; and (ii) one or more fusion partners.

In certain embodiments, the one or more fusion partners comprise a moiety that reduces aggregation of the engineered IL-12 p40 polypeptide.

In certain embodiments, the one or more fusion partners comprise a moiety that increases expression of the engineered IL-12 p40 polypeptide.

In certain embodiments, the one or more fusion partners comprise a moiety that increases serum half-life of the engineered IL-12 p40 polypeptide.

In certain embodiments, the one or more fusion partners comprise a targeting moiety.

In certain embodiments, the one or more fusion partners comprise a serum albumin, polyethylene glycol (PEG), or an antigen binding protein.

In certain embodiments, the antigen binding protein binds specifically to urokinase plasminogen activator receptor (uPAR).

In one aspect, the disclosure provides a fusion protein comprising: (i) a urokinase plasminogen activator receptor (uPAR) binding polypeptide; and (ii) a cytokine or variant thereof.

In certain embodiments, the uPAR binding polypeptide is linked to the cytokine with an amino acid linker.

In certain embodiments, the cytokine comprises a functional fragment thereof, functional variant thereof or circularly permuted variant thereof.

In certain embodiments, the cytokine is linked via one or more optional amino acid linkers to all or a portion of a receptor for which the cytokine has binding specificity.

In certain embodiments, the uPAR binding polypeptide comprises a urokinase plasminogen activator (uPA) polypeptide or variant thereof, capable of specifically binding uPAR.

In certain embodiments, the uPA variant is an amino acid terminal fragment (ATF) of uPA.

In certain embodiments, the ATF has the amino acid sequence as set forth in SEQ ID NO: 91, or an amino acid sequence with at least 80% identity to the amino acid sequence as set forth in SEQ ID NO: 91.

In certain embodiments, the ATF of uPA comprises one or more amino acid substitutions or deletions.

In certain embodiments, the uPA has the amino acid sequence set forth in SEQ ID NO: 90, or an amino acid sequence with at least 80% identity to the amino acid sequence as set forth in SEQ ID NO: 90.

In certain embodiments, the cytokine is circularly permuted IL-2 and the receptor is IL-2Rα.

In certain embodiments, the cytokine is circularly permuted IL-15 and the receptor is IL-15Rα.

In certain embodiments, the cytokine is circularly permuted IL-1 and the receptor is IL-1RI, IL-1RII.

In certain embodiments, the uPAR binding polypeptide is an anti-uPAR antigen binding protein.

In certain embodiments, the uPAR binding polypeptide is an scFv fragment of an anti-uPAR antibody.

In certain embodiments, the fusion protein comprising an amino acid sequence selected from the group consisting of: SEQ ID NOs: 98, 99, 100, 106, 107, 111, and 113.

In certain embodiments, the fusion protein comprising an amino acid sequence selected from the group consisting of SEQ ID NO: 98, 99, 111, and 112.

In certain embodiments, the uPAR binding agent, cytokine and receptor are of human origin.

In one aspect, the disclosure provides a method of treating cancer in a patient in need thereof comprising administering to the patient a therapeutically effective amount of a fusion protein recited above.

In certain embodiments, the cancer is selected from the group consisting of: melanoma, carcinoma, blastoma and lymphoma.

In one aspect, the disclosure provides a method of treating an inflammatory disease in a patient in need thereof comprising administering to the patient a therapeutically effective amount of a fusion protein recited above.

In certain embodiments, the inflammatory disease is selected from the group consisting of IBD and RA.

In one aspect, the disclosure provides a pharmaceutical composition comprising at least one fusion protein recited above and optionally a pharmaceutically acceptable excipient.

In one aspect, the disclosure provides a fusion protein comprising:
 a urokinase plasminogen activator receptor (uPAR) binding polypeptide linked via one or more optional amino acid linkers to:
  (i) a cytokine or variant thereof; or
  (ii) a checkpoint molecule modulator.

In certain embodiments, the cytokine comprises a functional fragment thereof, functional variant thereof or circularly permuted variant thereof.

In certain embodiments, the cytokine is linked via one or more optional amino acid linkers to all or a portion of a receptor for which the cytokine has binding specificity.

In certain embodiments, the uPAR binding polypeptide comprises a urokinase plasminogen activator (uPA) polypeptide or variant thereof, capable of specifically binding uPAR.

In certain embodiments, the uPA variant is an amino acid terminal fragment (ATF) of uPA.

In certain embodiments, the ATF has the amino acid sequence as set forth in SEQ ID NO: 91, or an amino acid sequence with at least 80% identity to the amino acid sequence as set forth in SEQ ID NO: 91.

In certain embodiments, the ATF of uPA comprises one or more amino acid substitutions or deletions.

In certain embodiments, the cytokine or checkpoint molecule modulator are selected from the group consisting of: IL-2, circularly permuted IL-2 (cpIL-2), IL-15, circularly permuted IL15 (cpIL-15), IL-6, circularly permuted IL-6 (cpIL-6), IL-10, IL-12, IL-15, GM-CSF, IFNγ, IFNα, 4-1BBB (CD131) or ligand thereof, OX40 or ligand thereof, PD-1, PD-L1, anti-PD-1 antibody, CTLA-4, anti-CTLA4 antibodies, GITR or ligand thereof, ICOS or ligand thereof, CD27, CD70, CD40 or ligand thereof.

In one aspect, the disclosure provides a method of treating cancer in a patient in need thereof comprising administering to the patient a therapeutically effective amount of a fusion protein recited above.

In certain embodiments, the cancer is selected from the group consisting of melanoma and lymphoma.

In one aspect, the disclosure provides a method of treating an inflammatory disease in a patient in need thereof comprising administering to the patient a therapeutically effective amount of a fusion protein recited above.

In certain embodiments, the inflammatory disease is selected from the group consisting of IBD and RA.

In one aspect, the disclosure provides a pharmaceutical composition comprising at least one fusion protein recited above and optionally a pharmaceutically acceptable excipient.

In one aspect, the disclosure provides a method of immunotherapy for treating cancer in a patient comprising administering a fusion protein recited above to a patient in need thereof.

In certain embodiments, the method further comprises administering a targeted cancer therapy to the patient.

In certain embodiments, the method further comprises administering a conventional cytotoxic therapy to the patient selected from chemotherapy, radiation therapy or both.

In certain embodiments, the method further comprises administering an immunotherapy selected from a cancer vaccine, a checkpoint inhibitor or a monoclonal antibody.

In certain embodiments, the uPAR binding polypeptide comprises M25 or an amino acid sequence homologous thereto having at least 80% identity at the amino acid level.

In certain embodiments, the uPAR binding polypeptide comprises P25 or an amino acid sequence homologous thereto having at least 80% identity at the amino acid level.

BRIEF DESCRIPTION OF THE DRAWINGS

FIG. 4A depicts a single chain human IL-12 p35/p40 fusion protein. FIG. 4B depicts a p35/serum albumin (e.g., human serum albumin or mouse serum albumin) fusion protein. FIG. 4C depicts a p35/Fc CH2-CH3 domain fusion protein paired with a Fab/Fc CH2-CH3 domain fusion protein. Each Fc domain contains a Knob-in-Hole (KiH) mutation to facilitate heterodimerization. FIG. 4D depicts a p40/scFv fusion protein. FIG. 4E depicts a p35/tandem scFv (scFv2) fusion protein. FIG. 4F depicts a p35/Fc CH2-CH3 domain fusion protein paired with a scFv/Fc CH2-CH3 domain fusion protein. Each Fc domain contains a KiH mutation to facilitate heterodimerization. FIG. 4G depicts a p40/Fab domain fusion protein. FIG. 4H depicts a p40/IgG fusion protein. A p40 protein is linked to the C terminus of each CH3 domain of the IgG.

DETAILED DESCRIPTION

Figure 1A:
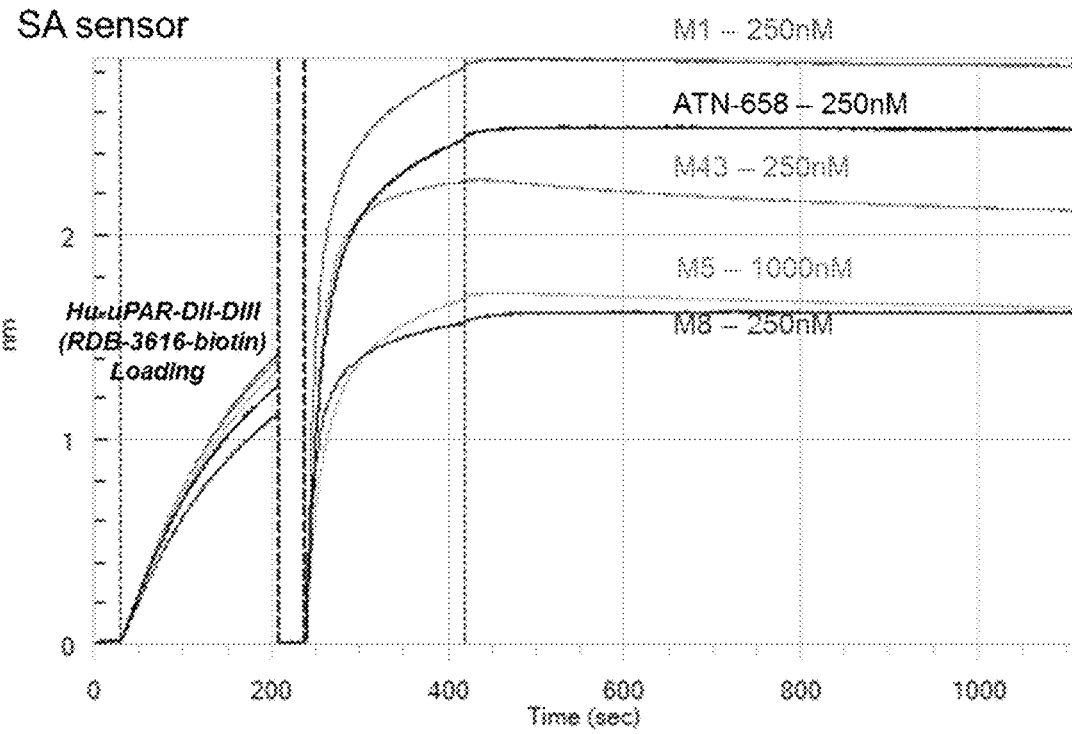
FIG. 1A-FIG. 1B depict anti-uPAR antibody binding data against the DII-DIII domain (FIG. 1A) or DIII domain alone (FIG. 1B) of human uPAR.

Provided herein are urokinase plasminogen activator receptor (uPAR) binding polypeptides (e.g., uPAR antigen binding proteins), and fusion proteins comprising said uPAR binding polypeptides and a cytokine or variant thereof. The disclosure further provides pharmaceutical compositions comprising the uPAR binding polypeptides and fusion proteins of the disclosure and methods of treating cancer with the same. The disclosure further provides engineered IL-12 p35 and p40 polypeptides.

Generally, nomenclature used in connection with cell and tissue culture, molecular biology, immunology, microbiology, genetics and protein and nucleic acid chemistry and hybridization described herein is well-known and commonly used in the art. The methods and techniques provided herein are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The nomenclature used in connection with, and the laboratory procedures and techniques of, analytical chemistry, synthetic organic chemistry, and medicinal and pharmaceutical chemistry described herein is well-known and commonly used in the art. Standard techniques are used for chemical syntheses, chemical analyses, pharmaceutical preparation, formulation, and delivery, and treatment of patients.

Unless otherwise defined herein, scientific and technical terms used herein have the meanings that are commonly understood by those of ordinary skill in the art. In the event of any latent ambiguity, definitions provided herein take precedent over any dictionary or extrinsic definition. Unless otherwise required by context, singular terms shall include pluralities and plural terms shall include the singular. The use of "or" means "and/or" unless stated otherwise. The use of the term "including," as well as other forms, such as "includes" and "included," is not limiting.

So that the invention may be more readily understood, certain terms are first defined.

Antigen Binding Proteins

As used herein, the term "antibody" or "antigen binding protein" refers to an immunoglobulin molecule or immunoglobulin derived molecule that specifically binds to, or is immunologically reactive with, an antigen or epitope, and includes both polyclonal and monoclonal antibodies, as well as functional antibody fragments, including but not limited to fragment antigen-binding (Fab) fragments, F(ab)$_2$ fragments, Fab' fragments, Fv fragments, recombinant IgG (rIgG) fragments, single chain variable fragments (scFv), and single domain antibodies (e.g., sdAb, sdFv, nanobody, VHH) fragments. The antibody may thus be a single domain antibody or comprise at least one variable light and at least one variable heavy chain. In one embodiment, the at least one variable light and at least one variable heavy chain are linked as a single polypeptide chain. The term "antibody" or "antigen binding protein" includes germline derived antibodies. The term "antibody" or "antigen binding protein" includes genetically engineered or otherwise modified forms of immunoglobulins, such as intrabodies, peptibodies, chimeric antibodies, fully human antibodies, humanized antibodies, heteroconjugate antibodies (e.g., bispecific antibodies, diabodies, triabodies, tetrabodies, tandem di-scFv, tandem tri-scFv) and the like. Unless otherwise stated, the term "antibody" or "antigen binding protein" should be understood to encompass functional antibody fragments thereof.

In certain embodiments, the antigen binding protein is multispecific (i.e., binds to two or more different target molecules or to two or more epitopes on the same target molecule). In certain embodiments, the antigen binding protein is bispecific and, e.g., binds to two different target molecules or to two epitopes on the same target molecule. In certain embodiments, the antibody is trispecific and e.g., binds to at least three different target molecules.

The antigen binding protein may be monovalent or multivalent, i.e., having one or more antigen binding sites. Non-limiting examples of monovalent antigen binding proteins include scFv, Fab, scFab, dAb, VHH, V(NAR), DARPins, affilins and nanobodies. A multivalent antigen binding protein can have two, three, four or more antigen binding sites. Non-limiting examples of multivalent antigen binding proteins include full-length immunoglobulins, F(ab')2fragments, bis-scFv (or tandem scFv or BiTE), DART, diabodies, scDb, DVD-Ig, IgG-scFab, scFab-Fc-scFab, IgG-scFv, scFv-Fc, scFv-fc-scFv, Fv2-Fc, FynomABs, quadroma, CrossMab, DuoBody, triabodies and tetrabodies. In some embodiments, the multivalent antigen binding protein is bivalent, i.e., two binding sites are present. In some embodiments, the multivalent antigen binding protein is bispecific, i.e., the antigen binding protein is directed against two different targets or two different target sites on one target molecule. In some embodiments, the multivalent antigen binding protein includes more than two, e.g., three or four different binding sites for three or four, respectively, different antigens. Such antigen binding protein is multivalent and multispecific, in particular tri- or tetra-specific, respectively.

As used herein, a "single-chain variable fragment" (scFv) is an antigen binding protein comprising a heavy chain variable domain (VH) linked to a light chain variable domain (VL). The VH and VL domains of the scFv are linked via any appropriate art recognized linker. Such linkers include, but are not limited to, repeated GGGGS amino acid sequences ("GGGGS" disclosed as SEQ ID NO: 152) or variants thereof. The scFv is generally free of antibody constant domain regions, although an scFv of the disclosure may be linked or attached to antibody constant domain regions (e.g., antibody Fc domain) to alter various properties of the scFv, including, but not limited to, increased serum or tissue half-life. An scFv generally has a molecular weight of about 25 kDa and a hydrodynamic radius of about 2.5 nm. In certain embodiments, the antigen binding protein comprises tandem scFv, i.e., a first scFv linked to a second scFv. The first and second scFv can be the same amino acid sequence and/or bind to the same epitope. Alternatively, the first and second scFv can be different amino acid sequences and/or bind to different epitopes.

As used herein, a "Fab fragment" or "Fab" is an antibody fragment comprising a light chain fragment comprising a variable light (VL) domain and a constant domain of the light chain (CL), and variable heavy (VH) domain and a first constant domain (CH1) of the heavy chain.

As used herein, a "VHH", "nanobody", or "heavy-chain only antibody" is an antigen binding protein comprising a single heavy chain variable domain derived from the species of the Camelidae family, which includes camels, llama, alpaca. A VHH generally has a molecular weight of about 15 kDa.

In one embodiment, the antigen binding protein comprises an Fc domain. The presence of an Fc domain may be advantageous to induce cytotoxic immune responses and/or activate complement (e.g., ADCC/ADCP or CDC effector function). Exemplary antibody formats including an Fc domain, without being limited to, are full-length immunoglobulins, DVD-Ig, scFv-Fc and scFv-Fc. scFv fusions, IgG-scFab, scFab-dsscFv, Fv2-Fc, IgG-scFv fusions (such as, e.g., bsAb, Bs1Ab, Bs2Ab, Bs3Ab, Ts1Ab, Ts2Ab, Knob-into-Holes (KiHs)), DuoBody and/or CrossMabs. An active Fc domain may increase the likelihood of pro-inflammatory cytokine release by T cells and other effector cells in the tumor microenvironment, which is believed to be part of the therapeutic mechanism of action. The Fc domain may be fully active or partly silenced to avoid over-stimulation of the immune system. In some embodiments, the Fc domain is inactive and does not stimulate pro-inflammatory cytokine release but does still improve half-life and/or stability of the antigen binding protein. In some embodiments, the antigen binding protein comprises a constant region selected from the group consisting of human IgG1, IgG2, IgG3 or IgG4 isotype. In other embodiments, the antigen binding protein comprises a constant region selected from the group consisting of murine IgG1, IgG2A, IgG2B or IgG3 isotype.

The antigen binding proteins of the disclosure may comprise one or more linkers for linking the domains of the antigen binding protein (e.g., linking a VH and VL to form a scFv, or linking multiple binding domains to form a multispecific antigen binding protein).

Illustrative examples of linkers include glycine polymers $(Gly)_n$; glycine-serine polymers $(Gly_nSer)_n$, where n is an integer of at least one, two, three, four, five, six, seven, or eight (SEQ ID NO: 249); glycine-alanine polymers; alanine-serine polymers; and other flexible linkers known in the art.

Glycine and glycine-serine polymers are relatively unstructured, and therefore may be able to serve as a neutral tether between domains of fusion proteins such as the antigen binding proteins described herein. Glycine accesses significantly more phi-psi space than other small side chain amino acids, and is much less restricted than residues with longer side chains (Scheraga, Rev. Computational Chem. 1: 1173-142 (1992)). A person skilled in the art will recognize that design of a antigen binding protein in particular embodiments can include linkers that are all or partially flexible, such that the linker can include flexible linker stretches as well as one or more stretches that confer less flexibility to provide a desired structure.

Linker sequences can, however, be chosen to resemble natural linker sequences, for example, using the amino acid stretches corresponding to the beginning of human CH1 and Cκ sequences or amino acid stretches corresponding to the lower portion of the hinge region of human IgG.

The design of the peptide linkers connecting VL and VH domains in the scFv moieties are flexible linkers generally composed of small, non-polar or polar residues such as, e.g., Gly, Ser and Thr. A particularly exemplary linker connecting the variable domains of the scFv moieties is the $(Gly_4Ser)_4$ linker (SEQ ID NO: 248), where 4 is the exemplary number of repeats of the motif. In certain embodiments, the linker comprises the amino acid sequence GGSGGGGSGGGSGGGGSGGGGSGGGSGG (SEQ ID NO: 150), GGGGSGGGGSGGGGS (SEQ ID NO: 149), or GGGSGGGGSG (SEQ ID NO: 246).

In certain embodiments, the amino acid linker comprises $(GGGGS)_n$ (SEQ ID NO: 148), wherein n is an integer between 1 and 5. In certain embodiments, the amino acid linker comprises $(GGGS)_n$ (SEQ ID NO: 247), wherein n is an integer between 1 and 5.

Other exemplary linkers include, but are not limited to the following amino acid sequences: GGG; DGGGS (SEQ ID NO: 250); TGEKP (SEQ ID NO: 251) (Liu et al., Proc. Natl. Acad. Sci.94: 5525-5530 (1997)); GGRR (SEQ ID NO: 252); $(GGGGS)_n$ (SEQ ID NO: 148) wherein n=1, 2, 3, 4 or 5 (Kim et al, Proc. Natl. Acad. Sci.93: 1156-1160 (1996)); EGKSSGSGSESKVD (SEQ ID NO: 253) (Chaudhary et al., Proc. Natl. Acad. Sci. 87: 1066-1070 (1990)); KESGSVSSEQLAQFRSLD (SEQ ID NO: 254) (Bird et al., Science 242:423-426 (1988)), GGRRGGGS (SEQ ID NO: 255); LRQRDGERP (SEQ ID NO: 256); LRQKDGGGSERP (SEQ ID NO: 257); and GST-SGSGKPGSGEGSTKG (SEQ ID NO: 258) (Cooper et al., Blood, 101(4): 1637-1644 (2003)). Alternatively, flexible linkers can be rationally designed using a computer program capable of modeling the 3D structure of proteins and peptides or by phage display methods.

The antibodies may comprise a variable light (VL) domain and a variable heavy (VH) domain. Each VL and VH domain further comprises a set of three CDRs.

As used herein, the term "complementarity determining region" or "CDR" refers to non-contiguous sequences of amino acids within antibody variable regions, which confer antigen specificity and binding affinity. In general, there are three CDRs in each heavy chain variable domain (HCDR1, HCDR2, HCDR3) and three CDRs in each light chain variable domain (LCDR1, LCDR2, LCDR3). "Framework regions" or "FRs" are known in the art to refer to the non-CDR portions of the variable domains of the heavy and light chains. In general, there are four FRs in each heavy chain variable domain (HFR1, HFR2, HFR3, and HFR4), and four FRs in each light chain variable domain (LFR1, LFR2, LFR3, and LFR4). Accordingly, an antibody variable region amino acid sequence can be represented by the formula FR1-CDR1-FR2-CDR2-FR3-CDR3-FR4. Each segment of the formula, i.e., FR1, CDR1, FR2, CDR2, FR3, CDR3, and FR4, represents a discrete amino acid sequence (or a polynucleotide sequence encoding the same) that can be mutated, including one or more amino acid substitutions, deletions, and insertions. In certain embodiments, an antibody variable light chain amino acid sequence can be represented by the formula LFR1-LCDR1-LFR2-LCDR2-LFR3-LCDR3-LFR4. In certain embodiments, an antibody variable heavy chain amino acid sequence can be represented by the formula HFR1-HCDR1-HFR2-HCDR2-HFR3-HCDR3-HFR4.

The precise amino acid sequence boundaries of a given CDR or FR can be readily determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273, 927-948 ("Chothia" numbering scheme), MacCallum et al., J. Mol. Biol. 262: 732-745 (1996), "Antibody-antigen interactions: Contact analysis and binding site topography," J. Mol. Biol. 262, 732-745. ("Contact" numbering scheme), Lefranc M P et al., "IMGT unique numbering for immunoglobulin and T cell receptor variable domains and Ig superfamily V-like domains," Dev Comp Immunol, 2003 January; 27(1):55-77 ("IMGT" numbering scheme), and Honegger A and Pluckthun A, "Yet another numbering scheme for immunoglobulin variable domains: an automatic modeling and analysis tool," J Mol Biol, 2001 Jun. 8; 309(3):657-70, ("AHo" numbering scheme).

The boundaries of a given CDR or FR may vary depending on the scheme used for identification. For example, the Kabat scheme is based structural alignments, while the Chothia scheme is based on structural information. Numbering for both the Kabat and Chothia schemes is based upon the most common antibody region sequence lengths, with insertions accommodated by insertion letters, for example, "30a," and deletions appearing in some antibodies. The two schemes place certain insertions and deletions ("indels") at different positions, resulting in differential numbering. The Contact scheme is based on analysis of complex crystal structures and is similar in many respects to the Chothia numbering scheme.

Thus, unless otherwise specified, a "CDR" or "complementary determining region," or individual specified CDRs (e.g., HCDR1, HCDR2), of a given antibody or fragment thereof, such as a variable domain thereof, should be understood to encompass a (or the specific) complementary determining region as defined by any of the known schemes. Likewise, unless otherwise specified, an "FR" or "framework region," or individual specified FRs (e.g., "HFR1," "HFR2") of a given antibody or fragment thereof, such as a variable domain thereof, should be understood to encompass a (or the specific) framework region as defined by any of the known schemes. In some instances, the scheme for identification of a particular CDR or FR is specified, such as the CDR as defined by the Kabat, Chothia, or Contact method. In other cases, the particular amino acid sequence of a CDR or FR is given.

In certain embodiments, the antigen binding proteins disclosed here are humanized. As used herein, the term "humanized" or "humanization" refers to an antigen binding protein that has been altered to make it more like a human antibody. Non-human antigen binding proteins, such as the murine antigen binding proteins disclosed herein, would elicit a negative immune reaction if administered to a human for therapy. It is therefore advantageous to humanize the non-human (e.g., murine) antigen binding proteins for later therapeutic use.

In certain embodiments, the antigen binding proteins are humanized through resurfacing (i.e., remodel the solvent-accessible residues of the non-human framework such that they become more human-like). Resurfacing strategies are described in more detail in WO2004/016740, WO2008/144757, and WO2005/016950, each of which is incorporated herein by reference.

In certain embodiments, the antigen binding proteins are humanized through CDR grafting (i.e., inserting the murine antigen binding protein CDRs into a human antibody acceptor framework).

As used herein, the term "affinity" refers to the strength of the interaction between an antibody's antigen binding site and the epitope to which it binds. As readily understood by those skilled in the art, an antibody or antigen binding protein affinity may be reported as a dissociation constant (KD) in molarity (M). The antibodies of the disclosure may have KD values in the range of $10^{-8}$ to $10^{-14}$ M. High affinity antibodies have KD values of $10^{-9}$ M (1 nanomolar, nM) and lower. For example, a high affinity antibody may have a KD value in the range of about 1 nM to about 0.01 nM. A high affinity antibody may have KD value of about 1 nM, about 0.9 nM, about 0.8 nM, about 0.7 nM, about 0.6 nM, about 0.5 nM, about 0.4 nM, about 0.3 nM, about 0.2 nM, or about 0.1 nM. Very high affinity antibodies have KD values of $10^{-12}$ M (1 picomolar, pM) and lower. Weak, or low, affinity antibodies may have KD values in the range of $10^{-1}$ to $10^{-4}$ M. Low affinity antibodies may have KD values of $10^{-4}$ M and higher, such as $10^{-4}$ M, $10^{-3}$ M, $10^{-2}$ M, or $10^{-1}$ M.

The ability of an antibody to bind to a specific antigenic determinant (e.g., uPAR) can be measured either through an enzyme-linked immunosorbent assay (ELISA) or other techniques familiar to one of skill in the art, e.g., surface plasmon resonance (SPR) technique (analyzed on a BIAcore instrument) (Liljeblad et al., Glyco J 17, 323-329 (2000)), and traditional binding assays (Heeley, Endocr Res 28, 217-229 (2002)).

Various antibody constant domain amino acid sequences used in the disclosure are recited below in Table 1.

TABLE 1

Antibody Constant Domain Amino Acid Sequences

| Sequence ID | Sequence |
|---|---|
| IgG1 CH1-hinge-CH2-CH3 (WT) | ASTKGPSVFPLAPSSKSTSGGTAAL GCLVKDYFPEPVTVSWNSGALTSGV HTFPAVLQSSGLYSLSSVVTVPSSS LGTQTYICNVNHKPSNTKVDKKVEP KSCDKTHTCPPCPAPELLGPSVFLF PPKPKDTLMISRTPEVTCVVVDVSH EDPEVKFNWYVDGVEVHNAKTKPRE EQYNSTYRVVSVLTVLHQDWLNGKE YKCKVSNKALPAPIEKTISKAKGQP REPQVYTLPPSRDELTKNQVSLTCL VKGFYPSDIAVEWESNGQPENNYKT TPPVLDSDGSFFLYSKLTVDKSRWQ QGNVFSCSVMHEALHNHYTQKSLSL SPGK (SEQ ID NO: 72) |
| IgG1 CH1-hinge-CH2-CH3 (LALA) | ASTKGPSVFPLAPSSKSTSGGTAAL GCLVKDYFPEPVTVSWNSGALTSGV HTFPAVLQSSGLYSLSSVVTVPSSS LGTQTYICNVNHKPSNTKVDKKVEP KSCDKTHTCPPCPAPEAAGGPSVFL FPPKPKDTLMISRTPEVTCVVVDVS HEDPEVKFNWYVDGVEVHNAKTKPR EEQYNSTYRVVSVLTVLHQDWLNGK EYKCKVSNKALPAPIEKTISKAKGQ PREPQVYTLPPSRDELTKNQVSLTC LVKGFYPSDIAVEWESNGQPENNYK TTPPVLDSDGSFFLYSKLTVDKSRW QQGNVFSCSVMHEALHNHYTQKSLS LSPGK (SEQ ID NO: 73) |
| IgG1 CH1-hinge-CH2-CH3 (LALA-PG) | ASTKGPSVFPLAPSSKSTSGGTAAL GCLVKDYFPEPVTVSWNSGALTSGV HTFPAVLQSSGLYSLSSWTVPSSSL GTQTYICNVNHKPSNTKVDKKVEPK SCDKTHTCPPCPAPEAAGGPSVFLF PPKPKDTLMISRTPEVTCVVVDVSH EDPEVKFNWYVDGVEVHNAKTKPRE EQYNSTYRVVSVLTVLHQDWLNGKE YKCKVSNKALGAPIEKTISKAKGQP REPQVYTLPPSRDELTKNQVSLTCL VKGFYPSDIAVEWESNGQPENNYKT TPPVLDSDGSFFLYSKLTVDKSRWQ QGNVFSCSVMHEALHNHYTQKSLSL SPGK (SEQ ID NO: 74) |
| IgG1 CH2-CH3 (T366W mutation-Knob) | EPKSSDKTHTCPPCPAPELLGGPSV FLFPPKPKDTLMISRTPEVTCVVVD VSHEDPEVKFNWYVDGVEVHNAKTK PREEQYNSTYRVVSVLTVLHQDWLN GKEYKCKVSNKALPAPIEKTISKAK GQPREPQVCTLPPSREEMTKNQVSL WCLVKGFYPSDIAVEWESNGQPENN YKTTPPVLDSDGSFFLYSKLTVDKS RWQQGNVFSCSVMHEALHNHYTQKS LSLSPGK (SEQ ID NO: 75) |
| IgG1 CH2-CH3 (T366S, L368A, Y407V mutations-Hole) | EPKSSDKTHTCPPCPAPELLGGPSV FLFPPKPKDTLMISRTPEVTCVVVD VSHEDPEVKFNWYVDGVEVHNAKTK PREEQYNSTYRVVSVLTVLHQDWLN GKEYKCKVSNKALPAPIEKTISKAK GQPREPQVCTLPPSREEMTKNQVSL SCAVKGFYPSDIAVEWESNGQPENN YKTTPPVLDSDGSFFLVSKLTVDKS RWQQGNVFSCSVMHEALHNHYTQKS LSLSPGK (SEQ ID NO: 76) |

TABLE 1-continued

Antibody Constant Domain Amino Acid Sequences

| Sequence ID | Sequence |
|---|---|
| IgG1 CH2-CH3 (Knob T366W; LALA-PG) | EPKSSDKTHTCPPCPAPEAAGGPSV FLFPPKPKDTLMISRTPEVTCVVVD VSHEDPEVKFNWYVDGVEVHNAKTK PREEQYNSTYRVVSVLTVLHQDWLN GKEYKCKVSNKALGAPIEKTISKAK GQPREPQVCTLPPSREEMTKNQVSL WCLVKGFYPSDIAVEWESNGQPENN YKTTPPVLDSDGSFFLYSKLTVDKS RWQQGNVFSCSVMHEALHNHYTQKS LSLSPGK (SEQ ID NO: 77) |
| IgG1 CH2-CH3 (Hole T366S, L368A, Y407V; LALA-PG; H435R; Y436F) | EPKSSDKTHTCPPCPAPEAAGGPSV FLFPPKPKDTLMISRTPEVTCVVVD VSHEDPEVKFNWYVDGVEVHNAKTK PREEQYNSTYRVVSVLTVLHQDWLN GKEYKCKVSNKALGAPIEKTISKAK GQPREPQVYTLPPCREEMTKNQVSL SCAVKGFYPSDIAVEWESNGQPENN YKTTPPVLDSDGSFFLVSKLTVDKS RWQQGNVFSCSVMHEALHNRFTQKS LSLSPGK (SEQ ID NO: 78) |
| IgG1 CH1 | ASTKGPSVFPLAPSSKSTSGGTAAL GCLVKDYFPEPVTVSWNSGALTSGV HTFPAVLQSSGLYSLSSVVTVPSSS LGTQTYICNVNHKPSNTKVDKKVEP KSC (SEQ ID NO: 79) |
| Kappa CL1 | TVAAPSVFIFPPSDEQLKSGTASVV CLLNNFYPREAKVQWKVDNALQSGN SQESVTEQDSKDSTYSLSSTLTLSK ADYEKHKVYACEVTHQGLSSPVTKS FNRGEC (SEQ ID NO: 80) |

Antigen Binding Protein Heterodimerization

In an aspect of the disclosure, antigen binding proteins comprising two Fc domains are heterodimerized through knobs-into-holes pairing (KiH). This dimerization technique utilizes protuberances ("knobs") and cavities ("holes") engineered into the interface of CH3 domains. Where a suitably positioned and dimensioned knob or hole exists at the interface of either the first or second CH3 domain, it is only necessary to engineer a corresponding hole or knob, respectively, at the adjacent interface, thus promoting and strengthening Fc domain pairing in the CH3/CH3 domain interface. A "knob" refers to an at least one amino acid side chain, typically a larger side chain, that protrudes from the interface of the CH3 portion of a first Fc domain. The protrusion creates a "knob" which is complementary to and received by a "hole" in the CH3 portion of a second Fc domain. The "hole" is an at least one amino acid side chain, typically a smaller side chain, which recedes from the interface of the CH3 portion of the second Fc domain. This technology is described, for example, in U.S. Pat. No. 5,821,333; Ridgway et al., Protein Engineering 9:617-621 (1996); and Carter P., J. Immunol. Methods 248: 7-15 (2001).

Exemplary amino acid residues that may act as a knob include arginine (R), phenylalanine (F), tyrosine (Y), and tryptophan (W). An existing amino acid residue in the CH3 domain may be replaced or substituted with a knob amino acid residue. Preferred amino acids to be substituted may include any amino acid with a small side chain, such as alanine (A), asparagine (N), aspartic acid (D), glycine (G), serine (S), threonine (T), or valine (V).

Exemplary amino acid residues that may act as a hole include alanine (A), serine (S), threonine (T), and valine (V). An existing amino acid residue in the CH3 domain may be replaced or substituted with a hole amino acid residue. Preferred amino acids to be substituted may include any amino acid with a large or bulky side chain, such as arginine (R), phenylalanine (F), tyrosine (Y), or tryptophan (W).

The CH3 domain can be derived from a human IgG1 antibody. Exemplary amino acid substitutions to the CH3 domain include T366Y, T366W, F405A, F405W, Y407T, Y407A, Y407V, T394S, and combinations thereof. A certain exemplary combination is T366Y or T366W for the knob mutation on a first CH3 domain and Y407T or Y407V for the hole mutation on a second CH3 domain.

In certain embodiments, the KiH Fc domain comprises a knob Fc portion comprising the amino acid substitution T366W and a hole Fc portion comprising the amino acid substitutions T366S, L368A, Y407V, according to Eu numbering. In certain embodiments, the hole Fc portion further comprises the amino acid substitutions H435R and Y436F, according to Eu numbering.

In certain embodiments of the disclosure, antigen binding proteins comprising two Fc domains are heterodimerized through Fab arm exchange (FAE). A human IgG1 possessing a P228S hinge mutation may contain an F405L or K409R CH3 domain mutation. Mixing of the two antibodies with a reducing agent leads to FAE. This technology is described in U.S. Pat. No. 9,212,230 and Labrijn A. F., Proc Natl Acad Sci USA 110(13): 5145-5150 (2013).

In certain embodiments of the disclosure, antigen binding proteins comprising two Fc domains are heterodimerized through electrostatic steering effects. This dimerization technique utilizes electrostatic steering to promote and strengthen Fc domain pairing in the CH3/CH3 domain interface. The charge complementarity between two CH3 domains is altered to favor heterodimerization (opposite charge pairing) over homodimerization (same charge pairing). In this method, the electrostatic repulsive forces prevent homodimerization. Exemplary amino acid residue substitutions may include K409D, K392D, and/or K370D in a first CH3 domain, and D399K, E356K, and/or E357K in a second CH3 domain. This technology is described in US Patent Application Publication No. 2014/0154254 A1 and Gunasekaran K., J Biol Chem 285(25): 19637-19646 (2010).

In certain embodiments of the disclosure, antigen binding proteins comprising two Fc domains are heterodimerized through hydrophobic interaction effects. This dimerization technique utilizes hydrophobic interactions instead of electrostatic ones to promote and strengthen Fc domain pairing in the CH3/CH3 domain interface. Exemplary amino acid residue substitution may include K409W, K360E, Q347E, Y349S, and/or S354C in a first CH3 domain, and D399V, F405T, Q347R, E357W, and/or Y349C in a second CH3 domain.

Preferred pairs of amino acid residue substitutions between a first CH3 domain and a second CH3 domain include K409W:D399V, K409W:F405T, K360E:Q347R, Y349S:E357W, and S354C:Y349C. This technology is described in US Patent Application Publication No. 2015/0307628 A1.

In certain embodiments of the disclosure, antigen binding proteins comprising two Fc domains are heterodimerized through the use of leucine zipper fusions. Leucine zipper domains fused to the C terminus of each CH3 domain of the antibody chains force heterodimerization. This technology is described in Wranik B., J Biol Chem 287(52): 43331-43339 (2012).

In certain embodiments of the disclosure, antigen binding proteins comprising two Fc domains are heterodimerized through the use of a Strand Exchange Engineered Domain (SEED) body. CH3 domains derived from an IgG and IgA format force heterodimerization. This technology is described in Muda M., Protein Eng. Des. Sel. 24(5): 447-454 (2011).

Unless otherwise stated, all antibody constant region numbering employed herein corresponds to the EU numbering scheme, as described in Edelman et al., Proc. Natl. Acad. Sci. USA 63(1): 78-85 (1969).

Additional methods of heterodimerization of heavy and/or light chains and the generation and purification of asymmetric antibodies are known in the art. See, for example, Klein C., mABs 4(6): 653-663 (2012), and U.S. Pat. No. 9,499,634, each of which is incorporated herein by reference.

Additional Fc domain mutations are envisioned to alter Fc function, including, but not limited to, altered Antibody Dependent Cellular Cytotoxicity (ADCC) and Complement-Dependent Cytotoxicity (CDC).

In certain embodiments, the antigen binding protein comprises a IgG1 constant domain with a L234A and L235A amino acid substitution, according to Eu numbering.

In certain embodiments, the antigen binding protein comprises a IgG1 constant domain with a P329G amino acid substitution, according to Eu numbering.

Urokinase Plasminogen Activator Receptor (uPAR) Binding Polypeptides

As used herein, the term "uPAR" or "urokinase plasminogen activator receptor" or "urokinase receptor" or "uPA receptor" or "CD87" or "Cluster of Differentiation 87" refers to the target of the antigen binding proteins described herein. uPAR is composed of three different domains of the Ly-6/uPAR/alpha-neuro toxin family. All three domains are involved in high affinity binding of the primary ligand, urokinase. Besides the primary ligand urokinase, uPAR interacts with several other proteins, including vitronectin, the uPAR associated protein (uPARAP), and the integrin family of membrane proteins.

As used herein, the term "binding polypeptide" or "binding protein" corresponds to a polypeptide that specifically binds to a target protein (e.g., uPAR). Binding polypeptides include, but are not limited to, antigen binding proteins, as described above, as well as ligands to the target protein. In certain embodiments, the binding polypeptide is a urokinase plasminogen activator (uPA) polypeptide or variant thereof, capable of specifically binding uPAR. In certain embodiments, the uPA variant is an amino acid terminal fragment (ATF) of uPA. In certain embodiments, the ATF has the amino acid sequence as set forth in SEQ ID NO: 91, or an amino acid sequence with at least 80% identity (e.g., 80%, 85%, 90%, 91%, 92%, 93%, 94%, 95%, 96%, 97%, 98%, or 99%) to the amino acid sequence as set forth in SEQ ID NO: 91. In certain embodiments, the ATF of uPA comprises one or more amino acid substitutions or deletions. In certain embodiments, the uPA has the amino acid sequence set forth in SEQ ID NO: 90, or an amino acid sequence with at least 80% identity (e.g., 80%, 85%, 90%, 91%, 92%, 93%, 94%, 95%, 96%, 97%, 98%, or 99%) to the amino acid sequence as set forth in SEQ ID NO: 90.

In one aspect, the disclosure provides an isolated antigen binding protein that binds specifically to urokinase plasminogen activator receptor (uPAR), comprising:

(a) an antibody heavy chain variable (VH) domain comprising:
  i) an HCDR1 amino acid sequence of GFNIKDEY (SEQ ID NO: 3), GFSLTNYG (SEQ ID NO: 11), GNTFTDYG (SEQ ID NO: 19), GTTFTDYG (SEQ ID NO: 41), or GYTFTSYG (SEQ ID NO: 27);
  ii) an HCDR2 amino acid sequence of IDPENGDT (SEQ ID NO: 4), IWSDGGT (SEQ ID NO: 12), INTNTGEP (SEQ ID NO: 20), or IYPRSGNT (SEQ ID NO: 28); and
  iii) an HCDR3 amino acid sequence of TGGNYVGWFPY (SEQ ID NO: 5), ARGGRSDLFAY (SEQ ID NO: 13), AHYSFDY (SEQ ID NO: 21), or AGKDYGSTYADY (SEQ ID NO: 29); and
(b) an antibody light chain variable (VL) domain comprising:
  iv) an LCDR1 amino acid sequence of SSVSY (SEQ ID NO: 6), QSIVHSNGNTY (SEQ ID NO: 14), ENIYSN (SEQ ID NO: 22), SSVSSRY (SEQ ID NO: 30);
  v) an LCDR2 amino acid sequence of DTS (SEQ ID NO: 7), KVS (SEQ ID NO: 15), AAT (SEQ ID NO: 23), or GTS (SEQ ID NO: 31); and
  vi) an LCDR3 amino acid sequence of QQWSSNPPY (SEQ ID NO: 8), FQGSHVPYT (SEQ ID NO: 16), QHFWGTPWT (SEQ ID NO: 24), QQYHSDPLT (SEQ ID NO: 32).

In certain embodiments, the antigen binding proteins of the disclosure comprise at least about 80% (e.g., 80%, 85%, 90%, 91%, 92%, 93%, 94%, 95%, 96%, 97%, 98%, or 99%) sequence similarity or identity to any of the HCDR1, HCDR2, HCDR3, LCDR1, LCDR2, or LCDR3 amino acid sequences as set forth above and in Table 3 and Table 8.

In certain embodiments, the VH domain comprises an amino acid sequence of SEQ ID NO: 33, SEQ ID NO: 34 SEQ ID NO: 37, SEQ ID NO: 42, or SEQ ID NO: 43, and the VL domain comprises an amino acid sequence of SEQ ID NO: 35, SEQ ID NO: 36, SEQ ID NO: 38, SEQ ID NO: 39, SEQ ID NO: 40, or SEQ ID NO: 44.

In certain embodiments, the antigen binding proteins of the disclosure comprise at least about 80% (e.g., 80%, 85%, 90%, 91%, 92%, 93%, 94%, 95%, 96%, 97%, 98%, or 99%) sequence similarity or identity to any of the VH or VL amino acid sequences as set forth above and in Table 3 and Table 8.

In certain embodiments:
a) the VH domain comprises an HCDR1 amino acid sequence of GFNIKDEY (SEQ ID NO: 3), an HCDR2 amino acid sequence of IDPENGDT (SEQ ID NO: 4), an HCDR3 amino acid sequence of TGGNYVGWFPY (SEQ ID NO: 5); and
b) the VL domain comprises an LCDR1 amino acid sequence of SSVSY (SEQ ID NO: 6), an LCDR2 amino acid sequence of DTS (SEQ ID NO: 7), and an LCDR3 amino acid sequence of QQWSSNPPY (SEQ ID NO: 8).

In certain embodiments:
a) the VH domain comprises an HCDR1 amino acid sequence of GFSLTNYG (SEQ ID NO: 11), an HCDR2 amino acid sequence of IWSDGGT (SEQ ID NO: 12), an HCDR3 amino acid sequence of ARGGRSDLFAY (SEQ ID NO: 13); and
b) the VL domain comprises an LCDR1 amino acid sequence of QSIVHSNGNTY (SEQ ID NO: 14), an LCDR2 amino acid sequence of KVS (SEQ ID NO: 15), and an LCDR3 amino acid sequence of FQGSHVPYT (SEQ ID NO: 16).

In certain embodiments:
a) the VH domain comprises an HCDR1 amino acid sequence of GNTFTDYG (SEQ ID NO: 19), or GTTFTDYG (SEQ ID NO: 41), an HCDR2 amino acid sequence of INTNTGEP (SEQ ID NO: 20), an HCDR3 amino acid sequence of AHYSFDY (SEQ ID NO: 21); and
b) the VL domain comprises an LCDR1 amino acid sequence of ENIYSN (SEQ ID NO: 22), an LCDR2 amino acid sequence of AAT (SEQ ID NO: 23), and an LCDR3 amino acid sequence of QHFWGTPWT (SEQ ID NO: 24).

In certain embodiments:
a) the VH domain comprises an HCDR1 amino acid sequence of GYTFTSYG (SEQ ID NO: 27), an HCDR2 amino acid sequence of IYPRSGNT (SEQ ID NO: 28), an HCDR3 amino acid sequence of AGKDYGSTYADY (SEQ ID NO: 29); and
b) the VL domain comprises an LCDR1 amino acid sequence of SSVSSRY (SEQ ID NO: 30), an LCDR2 amino acid sequence of GTS (SEQ ID NO: 31), and an LCDR3 amino acid sequence of QQYHSDPLT (SEQ ID NO: 32).

In certain embodiments:
a) the VH domain comprises an amino acid sequence of SEQ ID NO: 33, and the VL domain comprises an amino acid sequence of SEQ ID NO: 35;
b) the VH domain comprises an amino acid sequence of SEQ ID NO: 33, and the VL domain comprises an amino acid sequence of SEQ ID NO: 36;
c) the VH domain comprises an amino acid sequence of SEQ ID NO: 34, and the VL domain comprises an amino acid sequence of SEQ ID NO: 35;
d) the VH domain comprises an amino acid sequence of SEQ ID NO: 34, and the VL domain comprises an amino acid sequence of SEQ ID NO: 36;
e) the VH domain comprises an amino acid sequence of SEQ ID NO: 37, and the VL domain comprises an amino acid sequence of SEQ ID NO: 38;
f) the VH domain comprises an amino acid sequence of SEQ ID NO: 37, and the VL domain comprises an amino acid sequence of SEQ ID NO: 39;
g) the VH domain comprises an amino acid sequence of SEQ ID NO: 37, and the VL domain comprises an amino acid sequence of SEQ ID NO: 40;
h) the VH domain comprises an amino acid sequence of SEQ ID NO: 42, and the VL domain comprises an amino acid sequence of SEQ ID NO: 44; or
i) the VH domain comprises an amino acid sequence of SEQ ID NO: 43, and the VL domain comprises an amino acid sequence of SEQ ID NO: 44.

In certain embodiments, the VH domain and VL domain are attached with an amino acid linker.

In certain embodiments, the amino acid linker comprises (GGGGS)n (SEQ ID NO: 148), wherein n is an integer between 1 and 5.

In certain embodiments, the amino acid linker comprises the amino acid sequence GGGGSGGGGSGGGGS (SEQ ID NO: 149) or GGSGGGGSGGGSGGGGSGGGGSGGGSGG (SEQ ID NO: 150).

In certain embodiments, the antigen binding protein comprises a Fab fragment, a F(ab')2 fragment, an Fd fragment, an Fv fragment, a single chain Fv (scFv), a dAb fragment, a single domain antibody, or a nanobody.

In certain embodiments, the antigen binding protein comprises the amino acid sequence of any one of SEQ ID NOs: 56-71.

In certain embodiments, the antigen binding protein further comprises the amino acid sequence of any one of SEQ ID NOs: 72-78.

In certain embodiments, the antigen binding protein comprises an antibody heavy chain (HC) amino acid sequence of SEQ ID NO: 45, 46, 49, 53, or 54, and an antibody light chain (LC) amino acid sequence of SEQ ID NO: 47, 48, 50, 51, 52, and 55.

In certain embodiments:
a) the antibody HC comprises the amino acid sequence of SEQ ID NO: 45, and the antibody LC comprises the amino acid sequence of SEQ ID NO: 47;
b) the antibody HC comprises the amino acid sequence of SEQ ID NO: 45, and the antibody LC comprises the amino acid sequence of SEQ ID NO: 48;
c) the antibody HC comprises the amino acid sequence of SEQ ID NO: 46, and the antibody LC comprises the amino acid sequence of SEQ ID NO: 47;
d) the antibody HC comprises the amino acid sequence of SEQ ID NO: 46, and the antibody LC comprises the amino acid sequence of SEQ ID NO: 48;
e) the antibody HC comprises the amino acid sequence of SEQ ID NO: 49, and the antibody LC comprises the amino acid sequence of SEQ ID NO: 50;
f) the antibody HC comprises the amino acid sequence of SEQ ID NO: 49, and the antibody LC comprises the amino acid sequence of SEQ ID NO: 51;
g) the antibody HC comprises the amino acid sequence of SEQ ID NO: 49, and the antibody LC comprises the amino acid sequence of SEQ ID NO: 52;
h) the antibody HC comprises the amino acid sequence of SEQ ID NO: 53, and the antibody LC comprises the amino acid sequence of SEQ ID NO: 55; or
i) the antibody HC comprises the amino acid sequence of SEQ ID NO: 54, and the antibody LC comprises the amino acid sequence of SEQ ID NO: 55.

In certain embodiments, the antigen binding protein binds human uPAR with a KD of less than about $5\times10^{-8}$ M, less than about $1\times10^{-8}$ M, less than about $5\times10^{-9}$ M, less than about $1\times10^{-9}$ M, less than about $5\times10^{-10}$ M, or less than about $1\times10^{-10}$ M.

In certain embodiments, the antigen binding protein binds human uPAR in the presence of a uPAR ligand.

In certain embodiments, the antigen binding protein thereof binds uPAR ligand-bound human uPAR.

In certain embodiments, the antigen binding protein binds human uPAR on human uPAR-expressing cells, thereby producing a fluorescent signal detected with a fluorescently-labelled antibody that binds to the antigen binding protein, with an EC50 value of about 0.1 nM to about 3.0 nM.

In certain embodiments, the antigen binding protein binds human uPAR on human uPAR-expressing cells in the presence of a uPAR ligand.

In certain embodiments, the antigen binding protein binds a human uPAR DII-DIII domain or a human uPAR DIII domain.

In one aspect, the disclosure provides an isolated antigen binding protein that competes for binding with the antigen binding protein described above.

In one aspect, the disclosure provides an isolated antigen binding protein that binds the same epitope as the antigen binding protein described above.

In one aspect, the disclosure provides a pharmaceutical composition comprising the antigen binding protein described above, and a pharmaceutically acceptable carrier or diluent.

In one aspect, the disclosure provides an isolated nucleic acid molecule comprising a polynucleotide sequence that encodes the antigen binding protein described above.

In one aspect, the disclosure provides an expression vector comprising the polynucleotide sequence described above.

In one aspect, the disclosure provides a host cell comprising the expression vector described above.

In another aspect, the disclosure provides a method of manufacturing the antigen binding protein recited above, comprising the steps of:
 (i) cultivating the host cell recited above under conditions allowing expression of the antigen binding protein;
 (ii) recovering the antigen binding protein; and optionally
 (iii) further purifying and/or modifying and/or formulating the antigen binding protein.

Cytokines and Variants Thereof

As used herein, a "cytokine" is a general term that includes "lymphokine" (cytokines made by lymphocytes), "monokine" (cytokines made by monocytes), "chemokine" (cytokines with chemotactic activities), and "interleukin" (cytokines made by one leukocyte and acting on other leukocytes). Cytokines may act on the cells that secrete them (autocrine action), on nearby cells (paracrine action), or in some instances on distant cells (endocrine action). Pro-inflammatory cytokines are produced predominantly by activated macrophages and dendritic cells and are involved in the up-regulation of inflammatory reactions and include, but are not limited to IL-1β, IL-6, and TNF-α. Chemokines are usually assigned to 4 groups depending on the spacing of their first two cysteine residues: C-C chemokines (e.g. RANTES, monocyte chemoattractant protein or MCP-1, monocyte inflammatory protein or MIP-1α, and MIP-1β), C-X-C chemokines (e.g. IL-8 also called growth related oncogene or GRO/KC), C chemokines (e.g. lymphotactin), and CXXXC chemokines (e.g. fractalkine). Anti-inflammatory cytokines are a series of immunoregulatory molecules that dampen or control the pro-inflammatory response. Cytokines act in concert with specific cytokine inhibitors and soluble cytokine receptors to regulate immune responses. Major anti-inflammatory cytokines include, but are not limited to: interleukin (IL)-1 receptor antagonist, IL-4, IL-10, IL-11, and IL-13. Leukemia inhibitory factor, interferon-alpha, IL-6, IL-10 and transforming growth factor (TGF)-β are categorized as either anti-inflammatory or pro-inflammatory cytokines, under various circumstances. Specific cytokine receptors for IL-1, TNF-α, and IL-18 also function as inhibitors for pro-inflammatory cytokines.

The cytokine polypeptide of the fusion proteins disclosed herein can be any cytokine, including variants thereof, such as a functional fragment thereof, or a circularly permuted variant thereof. Useful cytokines include but are not limited to: IL-1α, IL-1β, IL-1Ra, IL-2, IL-3, IL-4, IL-5, IL-6, IL-7, IL-8, IL-9, IL-10, IL-11, IL-12, IL-12p35, IL-12p40, IL-13, IL-15, IL-17 family members, IL-18, IL-21, IL-22, IL-23, IL-23p19, IL-30 (IL-27p28), IL-33, IL-34, IL-35, IL-35p35, IL-36Ra, IL-36a, IL-36b, IL-36g, IL-37, IL-38, LIF, CNTF, Oncostatin M, CLCF-1, GM-CSF, Oxferritin, apolipoprotein e, tumor necrosis factor α (TNFα) interferon-alpha (IFNα), interferon-beta (IFNβ), or interferon-gamma (IFNγ). In certain embodiments, the cytokine or variant thereof is selected from the group consisting of IL-2, circularly permuted IL-2 (cpIL-2), IL-15, circularly permuted IL15 (cpIL-15), IL-6, circularly permuted IL-6 (cpIL-6), IL-10, or IL-12. In certain embodiments, the cytokine or variant thereof comprises at least one interluekin-12 (IL-12) subunit (e.g., p35 and p40). In certain embodiments, the IL-12 subunit comprises one or both of p35 and p40. In certain embodiments, the cytokine or variant thereof comprises a single-chain IL-12 (scIL-12) comprising a p35 polypeptide and a p40 polypeptide attached by an amino acid linker.

As used herein, the term "variant" refers to a polypeptide that differs from a reference polypeptide, but retains essential properties. A typical variant of a polypeptide differs in its primary amino acid sequence from another, reference polypeptide. Generally, differences are limited so that the sequences of the reference polypeptide and the variant are closely similar overall and, in many regions, identical. A variant and reference polypeptide may differ in amino acid sequence by one or more modifications (e.g., substitutions, additions, and/or deletions). A substituted or inserted amino acid residue may or may not be one encoded by the genetic code. A variant of a polypeptide may be naturally occurring such as an allelic variant, or it may be a variant that is not known to occur naturally. In addition, the term "variant" as used herein includes circular permutations of proteins and peptides.

As used herein, the terms "circular permutation" and "circularly permuted" "(CP or cp)", refers to the conceptual process of taking a linear protein, or its cognate nucleic acid sequence, and fusing the native N- and C-termini (directly or through a linker, using protein or recombinant DNA methodologies) to form a circular molecule, and then cutting (opening) the circular molecule at a different location to form a new linear protein, or cognate nucleic acid molecule, with termini different from the termini in the original molecule. Circular permutation thus preserves the sequence, structure, and function of a protein (other than the optional linker), while generating new C- and N-termini at different locations that, in accordance with one aspect of the disclosure, results in an improved orientation for fusing a desired polypeptide fusion partner as compared to the original ligand. Circular permutation also includes any process that results in a circularly permutated straight-chain molecule, as defined herein. In general, a circularly permuted molecule is de novo expressed as a linear molecule and does not formally go through the circularization and opening steps. The particular circular permutation of a molecule, herein, is designated by brackets containing, in the case of a circularly permuted protein, the amino acid residues between which the peptide bond is eliminated. For example, the designation IL6(Q182/Q180) designates a circularly permuted IL6 growth factor in which the opening site (position at which the peptide bond is eliminated) occurred between residues Q182 and Q180 of the unpermuted or unmodified native IL6, and thus the newly created N-terminus is a Glutamine which was formerly residue 182, and the newly created C-terminus is a Glutamine which was formerly residue 180. Circular permutated proteins, and methods of producing the same, are described in more detail in U.S. Pat. No. 9,359,415, incorporated herein by reference.

The terms "unpermuted," "native," "wild type," or "unmodified" ligand, polypeptide, protein, cytokine, for example, are used herein to provide a reference point for the cytokine, prior to its rearrangement into a circularly permuted molecule, as described above. Typically, the unmodified cytokine has amino and carboxy termini and an amino acid sequence that correspond substantially to the amino and carboxy termini and amino acid sequence of the cytokine or an independent domain of a protein, as it generally occurs in vivo. The unmodified cytokine may be a fully mature form or a precursor to the mature form (such as a pro-protein).

As used herein, a "fragment" refers to a segment of the polypeptide that is shorter than the reference protein. Fragments of a protein can have terminal (carboxy or amino-terminal) and/or internal deletions. Generally, fragments of a protein will be at least four (e.g., at least five, at least six, at least seven, at least eight, at least nine, at least 10, at least 12, at least 15, at least 18, at least 25, at least 30, at least 35, at least 40, at least 50, at least 60, at least 65, at least 70, at least 75, at least 80, at least 85, at least 90, or at least 100 or more) amino acids in length. Biologically active fragments or biologically active variants of any of the proteins, fusion proteins or fragments described herein have at least 25% (e.g., at least: 30%; 40%; 50%; 60%; 70%; 75%; 80%; 85%; 90%; 95%; 97%; 98%; 99%; 99.5%, or 100% or even greater) of the activity of the wild-type, full-length reference protein. In the case of a uPAR binding polypeptide, the relevant activity is the ability of the uPAR binding polypeptide is to bind to the target uPAR receptor. In the case of the cytokine polypeptide, the relevant activity is the ability bind its receptor and agonize or antagonize appropriately. Depending on their intended use, the polypeptides, biologically active fragments, or biologically active variants thereof can be of any species, but is preferably a mammal (e.g., a mouse, rat, rabbit, hamster, gerbil, dog, cat, goat, pig, cow, horse, whale, monkey, or human) and most preferably a human.

It is therefore understood that the disclosure provides (i) biologically active variants and (ii) biologically active fragments or biologically active variants thereof, of the full-length polypeptides (e.g., the various polypeptides of the fusion proteins of the invention including the uPAR binding polypeptide, cytokine and corresponding receptor or receptor fragment as described herein. Biologically active variants of full-length, preferably mature, wild-type proteins or fragments of the proteins can contain additions, deletions, or substitutions such as one, two, three, four, five, six, seven, eight, nine, ten, 12, 15, 20, 25, 30, 35, 40, or 50 conservative amino acid substitutions. A conservative substitution is the substitution of one amino acid for another with similar characteristics. Conservative substitutions include substitutions within the following groups: valine, alanine and glycine; leucine, valine, and isoleucine; aspartic acid and glutamic acid; asparagine and glutamine; serine, cysteine, and threonine; lysine and arginine; and phenylalanine and tyrosine. The non-polar hydrophobic amino acids include alanine, leucine, isoleucine, valine, proline, phenylalanine, tryptophan and methionine. The polar neutral amino acids include glycine, serine, threonine, cysteine, tyrosine, asparagine and glutamine. The positively charged (basic) amino acids include arginine, lysine and histidine. The negatively charged (acidic) amino acids include aspartic acid and glutamic acid. Any substitution of one member of the above-mentioned polar, basic or acidic groups by another member of the same group can be deemed a conservative substitution. By contrast, a non-conservative substitution is a substitution of one amino acid for another with dissimilar characteristics. Deletion variants can lack one, two, three, four, five, six, seven, eight, nine, ten, 11, 12, 13, 14, 15, 16, 17, 18, 19, or 20 amino acid segments (of two or more amino acids) or noncontiguous single amino acids. Additions (addition variants) include fusion proteins containing: (a) full-length, wild-type polypeptides or fragments thereof containing at least five amino acids; and (b) internal or terminal (C or N) irrelevant or heterologous amino acid sequences. In the context of such fusion proteins, the term "heterologous amino acid sequences" refers to an amino acid sequence other than (a). A fusion protein containing a peptide described herein and a heterologous amino acid sequence thus does not correspond in sequence to all or part of a naturally occurring protein. A heterologous sequence can be, for example a sequence used for purification of the recombinant protein (e.g., FLAG or polyhistidine (hexahistidine or 6×His (SEQ ID NO: 241))).

Engineered Interleukin 12 Subunits

IL-12 is a heterodimer, composed of a p35 subunit (i.e., IL-12 p35) and a p40 subunit (i.e., IL-12 p40). Optimal activity of IL-12 is achieved when the heterodimer forms and binds to the IL-12 receptor (e.g., a IL-12Rβ1/IL-12Rβ2 heterodimer). The two subunits (p35 and p40) can be linked together to form a single chain IL-12 (scIL-12), thereby eliminating the need for heterodimer assembly and increasing the activity of IL-12. However, scIL-12 is highly toxic when administered systemically. It is therefore advantageous to supply each IL-12 subunit separately.

Unfortunately, the IL-12 subunits are difficult to express and purify for therapeutic purposes. p35 shows little to no expression. Expression can be improved by linking p35 to a fusion partner, such as an antibody or fragment thereof, or human serum albumin (HSA). p35 is also prone to aggregation. p40 shows similar challenges. p40 can be expresses without a fusion partner, but the purified composition is frequently contaminated with a p40 homodimer (about 15-20%). p40 is also prone to dimerization and aggregation over time at 37° C. The instant disclosure provides engineered IL-12 subunits (i.e., p35 and p40 variants) that can overcome these challenges while retaining binding affinity of each other.

In one aspect, the disclosure provides an engineered IL-12 p35 polypeptide, comprising one or more amino acid substitutions at positions S27, N28, Q35, F39, S44, C74, M111, V114, M119, M145, F150, and L161 of SEQ ID NO: 81.

In certain embodiments, the engineered IL-12 p35 polypeptide further comprises one or both of a S27 and D188 amino acid substitution.

In certain embodiments, the amino acid substitution comprises M12S; S27D; N28R; Q35E; F39D or F39H; S44K; C74K, C74D, C74W, C74Y, or C74Q; M111F or M111W; V114I; M119L; M145L; F150Y; L161D or L161Q; D188N; or a combination thereof.

In certain embodiments, the amino acid substitution comprises N28R and Q35E.

In certain embodiments, the amino acid substitution comprises C74K.

In certain embodiments, the amino acid substitution comprises S27D, C74K, and D188N.

In certain embodiments, the engineered IL-12 p35 polypeptide comprises an amino acid sequence of SEQ ID NO: 81, SEQ ID NO: 82, or SEQ ID NO: 83, or an amino acid sequence with at least about 80% (e.g., 80%, 85%, 90%, 91%, 92%, 93%, 94%, 95%, 96%, 97%, 98%, or 99%) sequence similarity or identity to the amino acid sequences as set forth in SEQ ID NO: 81, SEQ ID NO: 82, or SEQ ID NO: 83.

In a further aspect, the disclosure provides a fusion protein comprising: (i) the engineered IL-12 p35 polypeptide recited above; and (ii) one or more fusion partners (e.g., a functional moiety or anti-uPAR antigen binding protein).

In certain embodiments, the one or more fusion partners comprise a moiety that reduces aggregation of the engineered IL-12 p35 polypeptide.

In certain embodiments, the one or more fusion partners comprise a moiety that increases expression of the engineered IL-12 p35 polypeptide.

In certain embodiments, the one or more fusion partners comprise a moiety that increases serum half-life of the engineered IL-12 p35 polypeptide.

In certain embodiments, the one or more fusion partners comprise a targeting moiety.

In certain embodiments, the one or more fusion partners comprise a serum albumin, polyethylene glycol (PEG), or an antigen binding protein.

In certain embodiments, the antigen binding protein binds specifically to urokinase plasminogen activator receptor (uPAR).

In one aspect, the disclosure provides an engineered IL-12 p40 polypeptide, comprising one or more amino acid substitutions at positions C177 and C252 of SEQ ID NO: 84.

In certain embodiments, the C177 amino acid substitution is selected from the group consisting of C177S, C177F, C177M, C177H, C177I, or C177Q.

In certain embodiments, the C252 amino acid substitution is C252S.

In certain embodiments, the p40 comprises an amino acid sequence of SEQ ID NO: 84, SEQ ID NO: 85, SEQ ID NO: 86, or SEQ ID NO: 87, or an amino acid sequence comprising at least about 80% (e.g., 80%, 85%, 90%, 91%, 92%, 93%, 94%, 95%, 96%, 97%, 98%, or 99%) sequence similarity or identity to the amino acid sequences as set forth in SEQ ID NO: 84, SEQ ID NO: 85, SEQ ID NO: 86, or SEQ ID NO: 87.

In a further aspect, the disclosure provides a fusion protein comprising: (i) the engineered IL-12 p40 polypeptide recited above; and (ii) one or more fusion partners (e.g., a functional moiety or anti-uPAR antigen binding protein).

In certain embodiments, the one or more fusion partners comprise a moiety that reduces aggregation of the engineered IL-12 p40 polypeptide.

In certain embodiments, the one or more fusion partners comprise a moiety that increases expression of the engineered IL-12 p40 polypeptide.

In certain embodiments, the one or more fusion partners comprise a moiety that increases serum half-life of the engineered IL-12 p40 polypeptide.

In certain embodiments, the one or more fusion partners comprise a targeting moiety.

In certain embodiments, the one or more fusion partners comprise a serum albumin, polyethylene glycol (PEG), or an antigen binding protein.

In certain embodiments, the antigen binding protein binds specifically to urokinase plasminogen activator receptor (uPAR).

Exemplary IL-12 amino acid sequences are recited below in Table 2.

TABLE 2

IL-12 Amino Acid Sequences

| Sequence ID | Sequence |
| --- | --- |
| p35 (WT) | RNLPVATPDPGMFPCLHHSQNLLRA VSNMLQKARQTLEFYPCTSEEIDHE DITKDKTSTVEACLPLELTKNESCL NSRETSFITNGSCLASRKTSFMMAL CLSSIYEDLKMYQVEFKTMNAKLLM DPKRQIFLDQNMLAVIDELMQALNF NSETVPQKSSLEEPDFYKTKIKLCI LLHAFRIRAVTIDRVMSYLNAS (SEQ ID NO: 81) |
| p35 (C74K mutation) | RNLPVATPDPGMFPCLHHSQNLLRA VSNMLQKARQTLEFYPCTSEEIDHE DITKDKTSTVEACLPLELTKNESKL NSRETSFITNGSCLASRKTSFMMAL CLSSIYEDLKMYQVEFKTMNAKLLM DPKRQIFLDQNMLAVIDELMQALNF NSETVPQKSSLEEPDFYKTKIKLCI LLHAFRIRAVTIDRVMSYLNAS (SEQ ID NO: 82) |
| p35 (S27D, C74K, and D188N mutations) | RNLPVATPDPGMFPCLHHSQNLLRA VDNMLQKARQTLEFYPCTSEEIDHE DITKDKTSTVEACLPLELTKNESKL NSRETSFITNGSCLASRKTSFMMAL CLSSIYEDLKMYQVEFKTMNAKLLM DPKRQIFLDQNMLAVIDELMQALNF NSETVPQKSSLEEPDFYKTKIKLCI LLHAFRIRAVTINRVMSYLNAS (SEQ ID NO: 83) |
| p40 (WT) | IWELKKDVYVVELDWYPDAPGEMVV LTCDTPEEDGITWTLDQSSEVLGSG KTLTIQVKEFGDAGQYTCHKGGEVL SHSLLLLHKKEDGIWSTDILKDQKE PKNKTFLRCEAKNYSGRFTCWWLTT ISTDLTFSVKSSRGSSDPQGVTCGA ATLSAERVRGDNKEYEYSVECQEDS ACPAAEESLPIEVMVDAVHKLKYEN YTSSFFIRDIIKPDPPKNLQLKPLK NSRQVEVSWEYPDTWSTPHSYFSLT FCVQVQGKSKREKKDRVFTDKTSAT VICRKNASISVRAQDRYYSSSWSEW ASVPCS (SEQ ID NO: 84) |
| p40 (C177S mutation) | IWELKKDVYVVELDWYPDAPGEMVV LTCDTPEEDGITWTLDQSSEVLGSG KTLTIQVKEFGDAGQYTCHKGGEVL SHSLLLLHKKEDGIWSTDILKDQKE PKNKTFLRCEAKNYSGRFTCWWLTT ISTDLTFSVKSSRGSSDPQGVTCGA ATLSAERVRGDNKEYEYSVECQEDS ASPAAEESLPIEVMVDAVHKLKYEN YTSSFFIRDIIKPDPPKNLQLKPLK NSRQVEVSWEYPDTWSTPHSYFSLT FCVQVQGKSKREKKDRVFTDKTSAT VICRKNASISVRAQDRYYSSSWSEW ASVPCS (SEQ ID NO: 85) |
| p40 (C252S mutation) | IWELKKDVYVVELDWYPDAPGEMVV LTCDTPEEDGITWTLDQSSEVLGSG KTLTIQVKEFGDAGQYTCHKGGEVL SHSLLLLHKKEDGIWSTDILKDQKE PKNKTFLRCEAKNYSGRFTCWWLTT ISTDLTFSVKSSRGSSDPQGVTCGA ATLSAERVRGDNKEYEYSVECQEDS ACPAAEESLPIEVMVDAVHKLKYEN YTSSFFIRDIIKPDPPKNLQLKPLK NSRQVEVSWEYPDTWSTPHSYFSLT FSVQVQGKSKREKKDRVFTDKTSAT VICRKNASISVRAQDRYYSSSWSEW ASVPCS (SEQ ID NO: 86) |
| p40 (C177S/ C252S mutation) | IWELKKDVYVVELDWYPDAPGEMVV LTCDTPEEDGITWTLDQSSEVLGSG KTLTIQVKEFGDAGQYTCHKGGEVL SHSLLLLHKKEDGIWSTDILKDQKE PKNKTFLRCEAKNYSGRFTCWWLTT ISTDLTFSVKSSRGSSDPQGVTCGA ATLSAERVRGDNKEYEYSVECQEDS ASPAAEESLPIEVMVDAVHKLKYEN YTSSFFIRDIIKPDPPKNLQLKPLK |

TABLE 2-continued

IL-12 Amino Acid Sequences

| Sequence ID | Sequence |
|---|---|
|  | NSRQVEVSWEYPDTWSTPHSYFSLT<br>FSVQVQGKSKREKKDRVFTDKTSAT<br>VICRKNASISVRAQDRYYSSSWSEW<br>ASVPCS<br>(SEQ ID NO: 87) |
| scIL-12<br>(WT p40-<br>WT p35) | IWELKKDVYVVELDWYPDAPGEMVV<br>LTCDTPEEDGITWTLDQSSEVLGSG<br>KTLTIQVKEFGDAGQYTCHKGGEVL<br>SHSLLLLHKKEDGIWSTDILKDQKE<br>PKNKTFLRCEAKNYSGRFTCWWLTT<br>ISTDLTFSVKSSRGSSDPQGVTCGA<br>ATLSAERVRGDNKEYEYSVECQEDS<br>ACPAAEESLPIEVMVDAVHKLKYEN<br>YTSSFFIRDIIKPDPPKNLQLKPLK<br>NSRQVEVSWEYPDTWSTPHSYFSLT<br>FCVQVQGKSKREKKDRVFTDKTSAT<br>VICRKNASISVRAQDRYYSSSWSEW<br>ASVPCSGGSGGGGSGGRNLPVATPD<br>PGMFPCLHHSQNLLRAVSNMLQKAR<br>QTLEFYPCTSEEIDHEDITKDKTST<br>VEACLPLELTKNESCLNSRETSFIT<br>NGSCLASRKTSFMMALCLSSIYEDL<br>KMYQVEFKTMNAKLLMDPKRQIFLD<br>QNMLAVIDELMQALNFNSETVPQKS<br>SLEEPDFYKTKIKLCILLHAFRIRA<br>VTIDRVMSYLNAS<br>(SEQ ID NO: 88) |
| ScIL-12<br>(WT p35-<br>WT p40) | RNLPVATPDPGMFPCLHHSQNLLRA<br>VSNMLQKARQTLEFYPCTSEEIDHE<br>DITKDKTSTVEACLPLELTKNESCL<br>NSRETSFITNGSCLASRKTSFMMAL<br>CLSSIYEDLKMYQVEFKTMNAKLLM<br>DPKRQIFLDQNMLAVIDELMQALNF<br>NSETVPQKSSLEEPDFYKTKIKLCI<br>LLHAFRIRAVTIDRVMSYLNASGGS<br>GGGGSGGIWELKKDVYVVELDWYPD<br>APGEMVVLTCDTPEEDGITWTLDQS<br>SEVLGSGKTLTIQVKEFGDAGQYTC<br>HKGGEVLSHSLLLLHKKEDGIWSTD<br>ILKDQKEPKNKTFLRCEAKNYSGRF<br>TCWWLTTISTDLTFSVKSSRGSSDP<br>QGVTCGAATLSAERVRGDNKEYEYS<br>VECQEDSACPAAEESLPIEVMVDAV<br>HKLKYENYTSSFFIRDIIKPDPPKN<br>LQLKPLKNSRQVEVSWEYPDTWSTP<br>HSYFSLTFCVQVQGKSKREKKDRVF<br>TDKTSATVICRKNASISVRAQDRYY<br>SSSWSEWASVPCS<br>(SEQ ID NO: 89) |

Fusion Proteins

The urokinase plasminogen activator receptor (uPAR) binding polypeptides described herein, including the uPAR antigen binding proteins described above, can be linked (i.e., attached or fused) to one or both of 1) a cytokine or variant thereof, and 2) a checkpoint molecule modulator. The uPAR antigen binding proteins are useful for targeting the linked protein (i.e., cytokine or checkpoint molecule modulator) to a uPAR-expressing tumor.

The phrase "checkpoint molecule modulator" refers to proteins or peptides that are capable of agonizing or antagonizing checkpoint molecules as appropriate to enhance a desirable immune response (e.g., agonizing immune stimulatory checkpoint molecules or antagonizing immune inhibitory checkpoint molecules) or to inhibit an undesirable immune response (e.g., antagonizing immune stimulatory checkpoint molecules for an inappropriate response). Stimulatory or costimulatory checkpoint molecules include, but are not limited to: CD27, CD70, CD28, CD40, CD40 ligand, CD122, CD137, OX40, GITR and its ligands, ICOS, CD131 (4-1BBB and its ligands). Inhibitory checkpoint molecules include, but are not limited to: Adenosine A2A receptor (A2AR), B7-H3, B7-H4, BTLA (B and T lymphocyte attenuator), CTLA-4 (cytotoxic T-lymphocyte-associated protein 4), IDO (indoleamine 2,3, dioxygenase), KIR (killer-cell immunoglobulin-like receptor), LAG3 (lymphocyte activation gene-3), PD-1 (programmed cell death-1 receptor) and its ligands PD-L1 (programmed death-ligand 1) and PD-L2 (programmed death-ligand 2), TIM-3 (T-cell immunoglobulin and mucin domain-containing protein 3), VISTA (v-domain Ig suppressor of T cell activation). Checkpoint molecule modulators used in the fusion proteins of the disclosure may include an inhibitory or stimulatory checkpoint molecule, a functional fragment thereof, a functional derivative thereof or a circularly permuted variant thereof.

In addition to antigen binding proteins, the uPAR binding polypeptide can comprise a peptide derived from integrins that block uPAR integration interactions. One such peptide is M25 having the amino acid sequence PRYQHIGL-VAMFRQNTG (SEQ ID NO: 157), a peptide derived from the (32 subunit of Mac-1 inhibited leukocyte adhesion to fibrinogen, vitronectin, and cytokine-stimulated endothelial cells. M25 also blocked the association of uPAR with β1 and impaired β1-integrin-dependent spreading and migration of human vascular smooth muscle cells on fibronectin and collagen (Simon D I, et al. (2000) *J Biol Chem.* 275:10228-34). A second peptide that inhibits uPAR-integrin complex formation, P25 having the amino acid sequence AEST-YHHLSLGYMYTLN (SEQ ID NO: 158), was able to decrease tumor cell attachment to vitronectin and increase tumor cell attachment to fibronectin (van der Pluijm G, et al. (2001) *Am J Pathol.* 159:971-82).

In one aspect, the disclosure provides a fusion protein comprising: (i) an antigen binding protein that binds specifically to urokinase plasminogen activator receptor (uPAR); and (ii) a cytokine or variant thereof.

In certain embodiments, the antigen binding protein and the cytokine or variant thereof are linked with an amino acid linker.

In certain embodiments, the cytokine or variant thereof is selected from the group consisting of IL-2, circularly permuted IL-2 (cpIL-2), IL-15, circularly permuted IL15 (cpIL-15), IL-6, circularly permuted IL-6 (cpIL-6), IL-10, or IL-12.

In certain embodiments, the cytokine or variant thereof comprises at least one interleukin-12 (IL-12) subunit (e.g., p35 and p40). In certain embodiments, the IL-12 subunit comprises one or both of p35 and p40. For example, but in no way limiting, the fusion protein comprises: (i) an antigen binding protein that binds specifically to uPAR; and (ii) a p35 polypeptide. Alternatively, the fusion protein comprises: (i) an antigen binding protein that binds specifically to uPAR; and (ii) a p40 polypeptide.

In certain embodiments, the p35 polypeptide comprises one or more amino acid substitutions at positions M12, S27, N28, Q35, F39, S44, C74, M111, V114, M119, M145, F150, L161, and D188 of SEQ ID NO: 81. In certain embodiments, the amino acid substitution comprises M12S; S27D; N28R; Q35E; F39D or F39H; S44K; C74K, C74D, C74W, C74Y, or C74Q; M111F or M111W; V114I; M119L; M145L; F150Y; L161D or L161Q; D188N; or a combination thereof. In certain embodiments, the amino acid substitution comprises N28R and Q35E. In certain embodiments, the amino acid substitution comprises S27D and D188N. In certain embodiments, the amino acid substitution comprises C74K. In certain embodiments, the amino acid substitution comprises S27D, C74K, and D188N. In certain embodiments, the p35 comprises an amino acid sequence of SEQ ID NO: 81, SEQ ID NO: 82, or SEQ ID NO: 83, or an amino acid sequence comprising at least about 80% (e.g., 80%, 85%, 90%, 91%, 92%, 93%, 94%, 95%, 96%, 97%, 98%, or 99%) sequence similarity or identity to the amino acid sequences as set forth in SEQ ID NO: 81, SEQ ID NO: 82, or SEQ ID NO: 83.

In certain embodiments, the p40 polypeptide comprises one or more amino acid substitution at positions C177 and C252 of SEQ ID NO: 84. In certain embodiments, the C177 amino acid substitution is selected from the group consisting of C177S, C177F, C177M, C177H, C177I, or C177Q. In certain embodiments, the C252 amino acid substitution is C252S. In certain embodiments, the p40 polypeptide comprises an amino acid sequence of SEQ ID NO: 84, SEQ ID NO: 85, SEQ ID NO: 86, or SEQ ID NO: 87, or an amino acid sequence comprising at least about 80% (e.g., 80%, 85%, 90%, 91%, 92%, 93%, 94%, 95%, 96%, 97%, 98%, or 99%) sequence similarity or identity to the amino acid sequences as set forth in SEQ ID NO: 84, SEQ ID NO: 85, SEQ ID NO: 86, or SEQ ID NO: 87.

In certain embodiments, the cytokine or variant thereof comprises a single-chain IL-12 (scIL-12) comprising a p35 polypeptide and a p40 polypeptide attached by an amino acid linker. In certain embodiments, the amino acid linker comprises the sequence GGSGGGGSGG (SEQ ID NO: 156). In certain embodiments, the scIL-12 comprises an amino acid sequence of SEQ ID NO: 88 or SEQ ID NO: 89, or an amino acid sequence comprising at least about 80% (e.g., 80%, 85%, 90%, 91%, 92%, 93%, 94%, 95%, 96%, 97%, 98%, or 99%) sequence similarity or identity to the amino acid sequences as set forth in SEQ ID NO: 88 or SEQ ID NO: 89.

In certain embodiments, the antigen binding protein of the fusion protein comprises:
  a) a VH domain comprising an HCDR1 amino acid sequence of GFNIKDEY (SEQ ID NO: 3), an HCDR2 amino acid sequence of IDPENGDT (SEQ ID NO: 4), an HCDR3 amino acid sequence of TGGNYVGWFPY (SEQ ID NO: 5); and
  b) a VL domain comprising an LCDR1 amino acid sequence of SSVSY (SEQ ID NO: 6), an LCDR2 amino acid sequence of DTS (SEQ ID NO: 7), and an LCDR3 amino acid sequence of QQWSSNPPY (SEQ ID NO: 8).

In certain embodiments, the antigen binding protein of the fusion protein comprises:
  a) a VH domain comprising an HCDR1 amino acid sequence of GFSLTNYG (SEQ ID NO: 11), an HCDR2 amino acid sequence of IWSDGGT (SEQ ID NO: 12), an HCDR3 amino acid sequence of ARGGRSDLFAY (SEQ ID NO: 13); and
  b) a VL domain comprising an LCDR1 amino acid sequence of QSIVHSNGNTY (SEQ ID NO: 14), an LCDR2 amino acid sequence of KVS (SEQ ID NO: 15), and an LCDR3 amino acid sequence of FQGSHVPYT (SEQ ID NO: 16).

In certain embodiments, the antigen binding protein of the fusion protein comprises:
  a) a VH domain comprising an HCDR1 amino acid sequence of GNTFTDYG (SEQ ID NO: 19), or GTTFTDYG (SEQ ID NO: 41), an HCDR2 amino acid sequence of INTNTGEP (SEQ ID NO: 20), an HCDR3 amino acid sequence of AHYSFDY (SEQ ID NO: 21); and
  b) a VL domain comprising an LCDR1 amino acid sequence of ENIYSN (SEQ ID NO: 22), an LCDR2 amino acid sequence of AAT (SEQ ID NO: 23), and an LCDR3 amino acid sequence of QHFWGTPWT (SEQ ID NO: 24).

In certain embodiments, the antigen binding protein of the fusion protein comprises:
  a) a VH domain comprising an HCDR1 amino acid sequence of GYTFTSYG (SEQ ID NO: 27), an HCDR2 amino acid sequence of IYPRSGNT (SEQ ID NO: 28), an HCDR3 amino acid sequence of AGKDYGSTYADY (SEQ ID NO: 29); and
  b) a VL domain comprising an LCDR1 amino acid sequence of SSVSSRY (SEQ ID NO: 30), an LCDR2 amino acid sequence of GTS (SEQ ID NO: 31), and an LCDR3 amino acid sequence of QQYHSDPLT (SEQ ID NO: 32).

In certain embodiments, the antigen binding protein of the fusion protein comprises:
  a) a VH domain comprising an amino acid sequence of SEQ ID NO: 33, and a VL domain comprising an amino acid sequence of SEQ ID NO: 35;
  b) a VH domain comprising an amino acid sequence of SEQ ID NO: 33, and a VL domain comprising an amino acid sequence of SEQ ID NO: 36;
  c) a VH domain comprising an amino acid sequence of SEQ ID NO: 34, and a VL domain comprising an amino acid sequence of SEQ ID NO: 35;
  d) a VH domain comprising an amino acid sequence of SEQ ID NO: 34, and a VL domain comprising an amino acid sequence of SEQ ID NO: 36;
  e) a VH domain comprising an amino acid sequence of SEQ ID NO: 37, and a VL domain comprising an amino acid sequence of SEQ ID NO: 38;
  f) a VH domain comprising an amino acid sequence of SEQ ID NO: 37, and a VL domain comprising an amino acid sequence of SEQ ID NO: 39;
  g) a VH domain comprising an amino acid sequence of SEQ ID NO: 37, and a VL domain comprising an amino acid sequence of SEQ ID NO: 40;
  h) a VH domain comprising an amino acid sequence of SEQ ID NO: 42, and a VL domain comprising an amino acid sequence of SEQ ID NO: 44; or
  i) a VH domain comprising an amino acid sequence of SEQ ID NO: 43, and a VL domain comprising an amino acid sequence of SEQ ID NO: 44.

In certain embodiments, the VH domain and VL domain are attached with an amino acid linker. In certain embodiments, the amino acid linker comprises (GGGGS)$_n$ (SEQ ID NO: 148), wherein n is an integer between 1 and 5. In certain embodiments, the amino acid linker comprises the amino acid sequence GGGGSGGGGSGGGGS (SEQ ID NO: 149) or GGSGGGGSGGGGSGGGGSGGGGSGGGSGG (SEQ ID NO: 150).

In certain embodiments, the antigen binding protein comprises a Fab fragment, a F(ab')2 fragment, an Fd fragment, an Fv fragment, a single chain Fv (scFv), a dAb fragment, a single domain antibody, or a nanobody.

In certain embodiments, the antigen binding protein comprises the amino acid sequence of any one of SEQ ID NOs: 56-71. In certain embodiments, the antigen binding protein further comprises the amino acid sequence of any one of SEQ ID NOs: 72-78.

In certain embodiments, the antigen binding protein comprises an antibody heavy chain (HC) amino acid sequence of SEQ ID NO: 45, 46, 49, 53, or 54, and an antibody light chain (LC) amino acid sequence of SEQ ID NO: 47, 48, 50, 51, 52, and 55.

In certain embodiments, the antigen binding protein comprises:
 a) an antibody HC comprising the amino acid sequence of SEQ ID NO: 45, and an antibody LC comprising the amino acid sequence of SEQ ID NO: 47;
 b) an antibody HC comprising the amino acid sequence of SEQ ID NO: 45, and an antibody LC comprising the amino acid sequence of SEQ ID NO: 48;
 c) an antibody HC comprising the amino acid sequence of SEQ ID NO: 46, and an antibody LC comprising the amino acid sequence of SEQ ID NO: 47;
 d) an antibody HC comprising the amino acid sequence of SEQ ID NO: 46, and an antibody LC comprising the amino acid sequence of SEQ ID NO: 48;
 e) an antibody HC comprising the amino acid sequence of SEQ ID NO: 49, and an antibody LC comprising the amino acid sequence of SEQ ID NO: 50;
 f) an antibody HC comprising the amino acid sequence of SEQ ID NO: 49, and an antibody LC comprising the amino acid sequence of SEQ ID NO: 51;
 g) an antibody HC comprising the amino acid sequence of SEQ ID NO: 49, and an antibody LC comprising the amino acid sequence of SEQ ID NO: 52;
 h) an antibody HC comprising the amino acid sequence of SEQ ID NO: 53, and an antibody LC comprising the amino acid sequence of SEQ ID NO: 55; or
 i) an antibody HC comprising the amino acid sequence of SEQ ID NO: 54, and an antibody LC comprising the amino acid sequence of SEQ ID NO: 55.

In another aspect, the disclosure provides a combination comprising a first fusion protein and a second fusion protein, wherein:
 (a) the first fusion protein comprises:
  (i) an antigen binding protein that binds specifically to a first epitope on urokinase plasminogen activator receptor (uPAR); and
  (ii) a IL-12 p35 subunit or variant thereof; and
 (b) the second fusion protein comprises:
  (i) an antigen binding protein that binds specifically to a second epitope on uPAR; and
  (ii) a IL-12 p40 subunit or variant thereof.

In certain embodiments, the first epitope and second epitope are the same.

In certain embodiments, the first epitope and second epitope are different.

Functional Moieties

The proteins of the disclosure (e.g., the uPAR binding proteins, the cytokines, and the fusion proteins) may be further conjugated (i.e., linked, attached, or fused) to functional moieties that impart desirable bioactivity on the proteins of the disclosure. Functional moieties include both protein functional moieties and non-protein functional moieties (e.g., PEG or polysaccharides). For example, but in no way limiting, a cytokine or variant thereof may be conjugated via an optional linker to the Fc region of an immunoglobulin or to human serum albumin (HSA) for the purpose of extending the half-life of the cytokine or variant thereof (e.g., an IL-12 p35-HSA or an IL-12 p40-HSA conjugate).

In certain embodiments, the functional moiety is an Fc region (i.e., Fc domain) of an immunoglobulin. In certain embodiments, the Fc region can be linked to the proteins of the disclosure (e.g., uPAR binding proteins, cytokines, and fusion proteins) via a single chain linker as described in WO 2016/100788, incorporated herein by reference. These linkers comprise a constant region of an immunoglobulin light chain (CL) linked to a CH1 constant region of an immunoglobulin heavy chain (scCLCH1 or scCH1CL linkers) fused to an Fc region of an immunoglobulin. For example, a fusion protein of the disclosure (e.g., a cytokine linked to a anti-uPAR antigen binding protein) may be further linked to an Fc region of an immunoglobulin via scCLCH1 or scCH1CL linkers. This type of linker confers favorable properties on the fusion protein of the disclosure of such as improved bioactivity and increased half-life on the fusion proteins of the disclosure.

The fusion proteins of the disclosure may be further stabilized in vivo and their half-life increased by binding to serum albumin molecules e.g. human serum albumin (HSA) which resist degradation and/or clearance or sequestration. These serum albumin molecules are naturally occurring proteins which themselves have a long half-life in vivo.

Linkers

Any of the proteins described herein (e.g., the uPAR binding proteins, the cytokine proteins, and the fusion proteins) can include one or more (e.g., two or more, three or more, four or more, five or more, six or more, or seven or more) linker moieties, which link one or more (or all) of the polypeptides of the fusion protein, link one or more cytokine proteins, or link one or more uPAR binding proteins (e.g., link the VH and VL domains of a uPAR antigen binding protein). In certain embodiments, the linker is an amino acid linker that can be one amino acid in length, but can be longer in length. For example, a linker peptide can be at least two (e.g., at least three, at least four, at least five, at least six, at least seven, at least eight, at least nine, at least 10, at least 11, at least 12, at least 13, at least 14, at least 15, at least 16, at least 17, at least 18, at least 19, at least 20, at least 25, at least 30, at least 35, at least 40, at least 45, at least 50, or at least 55 or more) amino acids long. Linker peptides can contain any amino acids.

In certain embodiments, any one or more linkers present in the proteins of the disclosure are selected from artificial flexible polypeptides comprising amino acids selected from Gly (G), and/or Ser (S). In certain embodiments, the linker is comprised of polypeptide of the general formula (GGGS (SEQ ID NO: 151))n (SEQ ID NO: 269) or (GGGGS (SEQ ID NO: 152))n (SEQ ID NO: 270) or (SGGSGGG (SEQ ID NO: 153))$_n$ (SEQ ID NO: 271) or (GGSGGSG (SEQ ID NO: 154))$_n$ (SEQ ID NO: 272) wherein n is an integer from 1 to 10. In certain embodiments, each linker is a polypeptide comprising from about 1 to about 100 amino acids, such as about 1-50 amino acids, about 1-25 amino acids, about 1-15 amino acids, about 1-10 amino acids, about 4-24 amino acids, about 5-20 amino acids, about 5-15 amino acids, and about 5-10 amino acids. In certain embodiments, the linker is (GGGGS (SEQ ID NO: 155)) n wherein n is 2 or 4 (SEQ ID NO: 273). Any linker may further comprise amino acids such as, for example, Lys (K), Thr (T), Glu (E), and Asp (D).

In certain embodiments, the amino acid linker comprises (GGGGS)$_n$ (SEQ ID NO: 148), wherein n is an integer between 1 and 5. In certain embodiments, the amino acid linker comprises the amino acid sequence GGGGSGGGGSGGGGS (SEQ ID NO: 149) or GGSGGGGSGGGSGGGGSGGGGSGGGSGG (SEQ ID NO: 150). In certain embodiments, the amino acid linker comprises the amino acid sequence GGS.

In certain embodiments, the linker may comprise one or more mucin proteins or mucin domains of proteins (e.g., any protein encoded for by a MUC gene (e.g., MUC1, MUC2, MUC3A, MUC3B, MUC4, MUC5AC, MUC5B, MUC6, MUC7, MUC8, MUC9, MUC11, MUC12, MUC13, MUC15, MUC16, MUC17, MUC19, MUC20, MUC21). Mucin domain proteins and polypeptides contain a high degree of glycosylation which structurally allows mucin proteins and other polypeptides comprising mucin domains to behave as stiffened random coils. The rod-like nature of the mucin domains can rigidly separate the bioactive protein (e.g., the cytokine) from the fusion partner (e.g., uPAR binding protein), and thereby be less susceptible to loss in activity either fusion partner.

Such mucin domain polypeptides useful in accordance with the disclosure are described in WO 2013/184939 and WO 2013/184938, incorporated herein by reference. These linkers are useful to provide optimal spacing between the polypeptides of the fusion proteins of the disclosure (e.g., between the ATF polypeptide and cytokine polypeptide) or for example, to provide an increase in half-life of the fusion protein as a whole regardless of location of the mucin domain in the fusion protein. For example, a mucin-domain may be present at the N-terminus or C-terminus of the fusion protein. Mucin domain polypeptide linkers may further be linked to the Fc region of an immunoglobulin polypeptide that may also function to increase half-life of the fusion protein of the invention as is described in WO 2013/184938.

Purification Tags

Any of the proteins described herein (e.g., the uPAR binding proteins, the cytokine proteins, and the fusion proteins) can include one or more (e.g., two or more, three or more, four or more, five or more, six or more, or seven or more) purification tags, which facilitate the purification of the proteins described herein. In certain embodiments, the purification tag is an avi tag (GLNDIFEAQKIEWHE; SEQ ID NO: 240). In certain embodiments, the purification tag is a 6×His tag (HHHHHH; SEQ ID NO: 241). One or both of the avi tag and 6×His tag (SEQ ID NO: 241) may be present on a single protein and in any order. In certain embodiments, the purification tag is linked to a protein described herein with a gly-ser linker. In certain embodiments, the gly-ser linker comprises GGS and/or GGSGGG (SEQ ID NO: 242). In certain embodiments, the purification is any one of GGSHHHHHHGGSGLNDIFEAQKIEWHE (SEQ ID NO: 243), GGSGGHHHHHHGGSGLNDIFEAQKIEWHE (SEQ ID NO: 244), and GGSGLNDIFEAQK-IEWHEGGSHHHHHH (SEQ ID NO: 245).

Expression of Antigen Binding Proteins, Cytokines, and Fusion Proteins

In one aspect, polynucleotides or nucleic acids encoding the antigen binding proteins (e.g., anti-uPAR antigen binding proteins), cytokines or variants thereof (e.g., engineered IL-12 p35 or engineered IL-12 p40), or fusion proteins (e.g., anti-uPAR antigen binding protein—cytokine fusion proteins) disclosed herein are provided. Methods of making an antigen binding protein, cytokine, or fusion protein comprising expressing these polynucleotides are also provided.

Polynucleotides encoding the antigen binding proteins, cytokines, or fusion proteins disclosed herein are typically inserted in an expression vector for introduction into host cells that may be used to produce the desired quantity of the antigen binding proteins or fusion proteins. Accordingly, in certain aspects, the disclosure provides expression vectors comprising polynucleotides disclosed herein and host cells comprising these vectors and polynucleotides.

The term "vector" or "expression vector" is used herein to mean vectors used in accordance with the present invention as a vehicle for introducing into and expressing a desired gene in a cell. As known to those skilled in the art, such vectors may readily be selected from the group consisting of plasmids, phages, viruses and retroviruses. In general, vectors compatible with the instant invention will comprise a selection marker, appropriate restriction sites to facilitate cloning of the desired gene and the ability to enter and/or replicate in eukaryotic or prokaryotic cells.

Numerous expression vector systems may be employed for the purposes of this invention. For example, one class of vector utilizes DNA elements which are derived from animal viruses such as bovine papilloma virus, polyoma virus, adenovirus, vaccinia virus, baculovirus, retroviruses (e.g., RSV, MMTV, MOMLV or the like), or SV40 virus. Others involve the use of polycistronic systems with internal ribosome binding sites. Additionally, cells which have integrated the DNA into their chromosomes may be selected by introducing one or more markers which allow selection of transfected host cells. The marker may provide for prototrophy to an auxotrophic host, biocide resistance (e.g., antibiotics) or resistance to heavy metals such as copper. The selectable marker gene can either be directly linked to the DNA sequences to be expressed, or introduced into the same cell by co-transformation. Additional elements may also be needed for optimal synthesis of mRNA. These elements may include signal sequences, splice signals, as well as transcriptional promoters, enhancers, and termination signals. In some embodiments, the cloned variable region genes are inserted into an expression vector along with the heavy and light chain constant region genes (e.g., human constant region genes) synthesized as discussed above.

In other embodiments, the antigen binding proteins may be expressed using polycistronic constructs. In such expression systems, multiple gene products of interest such as heavy and light chains of antibodies may be produced from a single polycistronic construct. These systems advantageously use an internal ribosome entry site (IRES) to provide relatively high levels of polypeptides in eukaryotic host cells. Compatible IRES sequences are disclosed in U.S. Pat. No. 6,193,980, which is incorporated by reference herein in its entirety for all purposes. Those skilled in the art will appreciate that such expression systems may be used to effectively produce the full range of polypeptides disclosed in the instant application.

More generally, once a vector or DNA sequence encoding an antibody, or fragment thereof, has been prepared, the expression vector may be introduced into an appropriate host cell. That is, the host cells may be transformed. Introduction of the plasmid into the host cell can be accomplished by various techniques well known to those of skill in the art. These include, but are not limited to, transfection (including electrophoresis and electroporation), protoplast fusion, calcium phosphate precipitation, cell fusion with enveloped DNA, microinjection, and infection with intact virus. See, Ridgway, A. A. G. "Mammalian Expression Vectors" Chapter 24.2, pp. 470-472 Vectors, Rodriguez and Denhardt, Eds. (Butterworths, Boston, Mass. 1988). Plasmid introduction into the host can be by electroporation. The transformed cells are grown under conditions appropriate to the production of the light chains and heavy chains, and assayed for heavy and/or light chain protein synthesis. Exemplary assay techniques include enzyme-linked immunosorbent assay (ELISA), radioimmunoassay (RIA), fluorescence-activated cell sorter analysis (FACS), immunohistochemistry and the like.

As used herein, the term "transformation" shall be used in a broad sense to refer to the introduction of DNA into a recipient host cell that changes the genotype and consequently results in a change in the recipient cell.

Along those same lines, "host cells" refers to cells that have been transformed with vectors constructed using recombinant DNA techniques and encoding at least one heterologous gene. In descriptions of processes for isolation of polypeptides from recombinant hosts, the terms "cell" and "cell culture" are used interchangeably to denote the source of antibody unless it is clearly specified otherwise. In other words, recovery of polypeptide from the "cells" may mean either from spun down whole cells, or from the cell culture containing both the medium and the suspended cells.

In one embodiment, a host cell line used for antibody expression or fusion protein expression is of mammalian origin. Those skilled in the art can determine particular host cell lines which are best suited for the desired gene product to be expressed therein. Exemplary host cell lines include, but are not limited to, DG44 and DUXB11 (Chinese hamster ovary lines, DHFR minus), HELA (human cervical carcinoma), CV-1 (monkey kidney line), COS (a derivative of CV-1 with SV40 T antigen), R1610 (Chinese hamster fibroblast) BALBC/3T3 (mouse fibroblast), HAK (hamster kidney line), SP2/O (mouse myeloma), BFA-1c1BPT (bovine endothelial cells), RAJI (human lymphocyte), 293 (human kidney) and the like. In one embodiment, the cell line provides for altered glycosylation, e.g., afucosylation, of the antibody expressed therefrom (e.g., PER.C6® (Crucell) or FUT8-knock-out CHO cell lines (Potelligent® cells) (Biowa, Princeton, N.J.)). Host cell lines are typically available from commercial services, e.g., the American Tissue Culture Collection, or from published literature.

In vitro production allows scale-up to give large amounts of the desired polypeptides. Techniques for mammalian cell cultivation under tissue culture conditions are known in the art and include homogeneous suspension culture, e.g., in an airlift reactor or in a continuous stirrer reactor, or immobilized or entrapped cell culture, e.g., in hollow fibers, microcapsules, on agarose microbeads or ceramic cartridges. If necessary and/or desired, the solutions of polypeptides can be purified by the customary chromatography methods, for example gel filtration, ion-exchange chromatography, chromatography over DEAE-cellulose and/or (immuno-) affinity chromatography.

Genes encoding the antigen binding proteins featured in the invention can also be expressed non-mammalian cells such as bacteria or yeast or plant cells. In this regard it will be appreciated that various unicellular non-mammalian microorganisms such as bacteria can also be transformed, i.e., those capable of being grown in cultures or fermentation. Bacteria, which are susceptible to transformation, include members of the enterobacteriaceae, such as strains of *Escherichia coli* or *Salmonella; Bacillaceae*, such as *Bacillus subtilis; Pneumococcus; Streptococcus*, and *Haemophilus influenzae*. It will further be appreciated that, when expressed in bacteria, the proteins can become part of inclusion bodies. The proteins must be isolated, purified and then assembled into functional molecules.

In addition to prokaryotes, eukaryotic microbes may also be used. *Saccharomyces cerevisiae*, or common baker's yeast, is the most commonly used among eukaryotic microorganisms, although a number of other strains are commonly available. For expression in *Saccharomyces*, the plasmid YRp7, for example (Stinchcomb et al., Nature, 282:39 (1979); Kingsman et al., Gene, 7:141 (1979); Tschemper et al., Gene, 10:157 (1980)), is commonly used. This plasmid already contains the TRP1 gene which provides a selection marker for a mutant strain of yeast lacking the ability to grow in tryptophan, for example ATCC No. 44076 or PEP4-1 (Jones, Genetics, 85:12 (1977)). The presence of the trp1 lesion as a characteristic of the yeast host cell genome then provides an effective environment for detecting transformation by growth in the absence of tryptophan.

Methods of Administering Antigen Binding Proteins, Cytokines, and Fusion Proteins Methods of preparing and administering antigen binding proteins, cytokines, or fusion proteins of the disclosure as well as the nucleic acids described herein, the vectors described herein, the host cell cells described herein or the compositions described herein to a subject are well known to or are readily determined by those skilled in the art. The route of administration of the antigen binding proteins of the current disclosure may, e.g., be oral, parenteral, by inhalation, or topical. The term parenteral as used herein includes intravenous, intraarterial, intraperitoneal, intramuscular, subcutaneous, rectal or vaginal administration. In certain embodiments, the antigen binding proteins or fusion proteins are administered intravenously. The term intraocular as used herein includes, but is not limited to, subconjunctival, intravitreal, retrobulbar, or intracameral. The term topical as used herein includes, but is not limited to, administration with liquid or solution eye drops, emulsions (e.g., oil-in-water emulsions), suspensions, and ointments.

While all these forms of administration are clearly contemplated as being within the scope of the current disclosure, a form for administration would be a solution for injection. Usually, a suitable pharmaceutical composition for injection may comprise a buffer (e.g., acetate, phosphate or citrate buffer), a surfactant (e.g., polysorbate), optionally a stabilizer agent (e.g., human albumin), etc. However, in other methods compatible with the teachings herein, the modified antibodies can be delivered directly to the site of the adverse cellular population thereby increasing the exposure of the diseased tissue to the therapeutic agent.

Effective doses of the compositions of the present disclosure, for the treatment of the related conditions vary depending upon many different factors, including means of administration, target site, physiological state of the patient, whether the patient is human or an animal, other medications administered, and whether treatment is prophylactic or therapeutic. Usually, the patient is a human, but non-human mammals, including transgenic mammals, can also be treated. Treatment dosages may be titrated using routine methods known to those of skill in the art to optimize safety and efficacy.

As previously discussed, the antigen binding proteins or fusion proteins of the present disclosure, conjugates or recombinants thereof may be administered in a pharmaceutically effective amount for the in vivo treatment of mammalian disorders. In this regard, it will be appreciated that the disclosed antigen binding proteins will be formulated to facilitate administration and promote stability of the active agent.

Pharmaceutical compositions in accordance with the present disclosure typically include a pharmaceutically acceptable, non-toxic, sterile carrier such as physiological saline, nontoxic buffers, preservatives and the like. For the purposes of the instant application, a pharmaceutically effective amount of the antigen binding proteins shall be held to mean an amount sufficient to achieve effective binding to an antigen and to achieve a benefit, e.g., to ameliorate symptoms of a disease or disorder or to detect a substance or a cell. In the case of tumor cells, the antigen binding proteins will typically be capable of interacting with selected immunoreactive antigens on neoplastic or immunoreactive cells and provide an increase in the death of those cells. Of course, the pharmaceutical compositions of the present disclosure may be administered in single or multiple doses to provide for a pharmaceutically effective amount of the modified binding polypeptide.

In keeping with the scope of the present disclosure, the antigen binding proteins of the disclosure may be administered to a human or other animal in accordance with the aforementioned methods of treatment in an amount sufficient to produce a therapeutic or prophylactic effect. The antigen binding proteins of the disclosure can be administered to such human or other animal in a conventional dosage form prepared by combining the antigen binding proteins of the disclosure with a conventional pharmaceutically acceptable carrier or diluent according to known techniques. It will be recognized by one of skill in the art that the form and character of the pharmaceutically acceptable carrier or diluent is dictated by the amount of active ingredient with which it is to be combined, the route of administration and other well-known variables. Those skilled in the art will further appreciate that a cocktail comprising one or more species of antigen binding proteins described in the current disclosure may prove to be particularly effective. Similarly, the nucleic acids described herein, the vectors described herein, the host cell cells described herein (in particular the immune cells bearing a CAR) or the compositions described herein may be administered to a human or other animal in accordance with the methods of treatment described above in an amount sufficient to produce a therapeutic or prophylactic effect.

"Efficacy" or "in vivo efficacy" as used herein refers to the response to a therapy by the pharmaceutical composition of the disclosure, using e.g., standardized response criteria, such as standard ophthalmological response criteria. The success or in vivo efficacy of the therapy using a pharmaceutical composition of the disclosure refers to the effectiveness of the composition for its intended purpose, i.e., the ability of the composition to cause its desired effect. The in vivo efficacy may be monitored by established standard methods for the specific diseases. In addition, various disease specific clinical chemistry parameters and other established standard methods may be used.

In some embodiments, the compounds and cells described herein are administered in combination with one or more different pharmaceutical compounds. Generally, therapeutic use of the compounds and cells described herein may be in combination with one or more therapies selected from the group of antibody therapy, chemotherapy, cytokine therapy, dendritic cell therapy, gene therapy, hormone therapy, laser light therapy, radiation therapy or vaccine therapy.

Methods of Treatment

Methods of treating diseases or disorders associated with uPAR expression in a patient by administering the antigen binding proteins, cytokines, or fusion proteins of the disclosure are described herein. In certain embodiments, the disease or disorder associated with uPAR expression is cancer (e.g., a uPAR-expressing cancer or uPAR-expressing tumor).

In an aspect, the disclosure provides a method of treating cancer in a patient in need thereof comprising administering to the patient a therapeutically effective amount of the pharmaceutical compositions, uPAR binding proteins, or fusion proteins described herein.

In certain embodiments, the pharmaceutical composition or fusion protein is administered simultaneously with a cytokine or variant thereof or a second fusion protein, wherein the second fusion protein comprises a different cytokine or variant thereof from the first fusion protein.

In certain embodiments, the pharmaceutical composition or fusion protein is administered sequentially a cytokine or variant thereof or a second fusion protein, wherein the second fusion protein comprises a different cytokine or variant thereof from the first fusion protein.

In certain embodiments, the cytokine or variant thereof comprises a IL-12 p35 subunit or an IL-12 p40 subunit.

In certain embodiments, the fusion protein clearance rate in a tumor of the patient is slower than the fusion protein clearance rate in serum of the patient.

In one aspect, the disclosure provides a method of treating cancer in a patient in need thereof comprising administering to the patient a therapeutically effective amount of a fusion protein and a non-fusion IL-12 subunit, wherein:
  (a) the fusion protein comprises:
    (i) an antigen binding protein that binds specifically to urokinase plasminogen activator receptor (uPAR); and
    (ii) a IL-12 p35 subunit or variant thereof, or a IL-12 p40 subunit or variant thereof; and
  (b) the non-fusion IL-12 subunit comprising a IL-12 p35 subunit or variant thereof, or a IL-12 p40 subunit or variant thereof,
  wherein when the fusion protein comprises a IL-12 p35 subunit or variant thereof, the non-fusion IL-12 subunit comprises a IL-12 p40 subunit or variant thereof, and when the fusion protein comprises a IL-12 p40 subunit or variant thereof, the non-fusion IL-12 subunit comprises a IL-12 p35 subunit or variant thereof.

In certain embodiments, the fusion protein and non-fusion IL-12 subunit are administered sequentially.

In certain embodiments, one or both of the fusion protein and non-fusion IL-12 subunit are administered intravenously.

In certain embodiments, the fusion protein is administered first, followed by administering the non-fusion IL-12 subunit after a sufficient amount of time has elapsed for the fusion protein to accumulate in a tumor of the patient.

In certain embodiments, the fusion protein is administered first, followed by administering the non-fusion IL-12 subunit after a sufficient amount of time has elapsed for the fusion protein concentration to substantially reduce in serum of the patient.

In one aspect, the disclosure provides a method of treating cancer in a patient in need thereof comprising administering to the patient a therapeutically effective amount of a first fusion protein and a second fusion protein, wherein:
  (a) the first fusion protein comprises:
    (i) an antigen binding protein that binds specifically to a first epitope on urokinase plasminogen activator receptor (uPAR); and
    (ii) a IL-12 p35 subunit or variant thereof; and
  (b) the second fusion protein comprises:
    (i) an antigen binding protein that binds specifically to a second epitope on uPAR; and
    (ii) a IL-12 p40 subunit or variant thereof.

In certain embodiments, the first epitope and second epitope are the same.

In certain embodiments, the first epitope and second epitope are different.

In certain embodiments, the first fusion protein and second fusion protein are administered sequentially.

In certain embodiments, one or both of the first fusion protein and second fusion protein are administered intravenously.

In certain embodiments, the first fusion protein is administered first, followed by administering the second fusion protein after a sufficient amount of time has elapsed for the first fusion protein to accumulate in a tumor of the patient.

In certain embodiments, the first fusion protein is administered first, followed by administering the second fusion protein after a sufficient amount of time has elapsed for the first fusion protein concentration to substantially reduce in serum of the patient.

In certain embodiments, the second fusion protein is administered first, followed by administering the first fusion protein after a sufficient amount of time has elapsed for the second fusion protein to accumulate in a tumor of the patient.

In certain embodiments, the second fusion protein is administered first, followed by administering the first fusion protein after a sufficient amount of time has elapsed for the second fusion protein concentration to substantially reduce in serum of the patient.

It will be readily apparent to those skilled in the art that other suitable modifications and adaptations of the methods described herein may be made using suitable equivalents without departing from the scope of the embodiments disclosed herein. Having now described certain embodiments in detail, the same will be more clearly understood by reference to the following examples, which are included for purposes of illustration only and are not intended to be limiting.

EXAMPLES

Example 1—Generation & Characterization of Parental Anti-uPAR Antibodies

NZBW mice were immunized with alternating injection of recombinant human uPAR and mouse uPAR extracellular domain protein. Hybridomas were generated and screened against human and mouse uPAR in an ELISA and in uPAR overexpressing HEK293 cells to identify antibodies with binding specificity to human and mouse uPAR. Top clones were further screened by ELISA for binding to uPAR ligand uPA-bound variants, including 1) human uPAR with and without human uPA, 2) mouse uPAR with and without mouse uPA, and 3) human uPAR with an H47C/N259C mutation (a human uPAR variant mimicking ligand-bound conformation). The following amino acid sequences were used for screening:

Human uPAR-His-AviTag fusion
(SEQ ID NO: 259)
LRCMQCKTNGDCRVEECALGQDLCRTTIVRLWEEGEELELVEKSCTHSEK
TNRTLSYRTGLKITSLTEVVCGLDLCNQGNSGRAVTYSRSRYLECISCGS
SDMSCERGRHQSLQCRSPEEQCLDVVTHWIQEGEEGRPKDDRHLRGCGYL
PGCPGSNGFHNNDTFHFLKCCNTTKCNEGPILELENLPQNGRQCYSCKGN
STHGCSSEETFLIDCRGPMNQCLVATGTHEPKNQSYMVRGCATASMCQHA
HLGDAFSMNHIDVSCCTKSGCNHPDLDVQYRGGSHHHHHHGGSGLNDIFE
AQKIEWHE Mouse uPAR-His-AviTag fusion
(SEQ ID NO: 260)
LQCMQCESNQSCLVEECALGQDLCRTTVLREWQDDRELEVVTRGCAHSEK
TNRTMSYRMGSMIISLTETVCATNLCNRPRPGARGRAFPQGRYLECASCT
SLDQSCERGREQSLQCRYPTEHCIEVVTLQSTERSLKDEDYTRGCGSLPG
CPGTAGFHSNQTFHFLKCCNYTHCNGGPVLDLQSFPPNGFQCYSCEGNNT
LGCSSEEASLINCRGPMNQCLVATGLDVLGNRSYTVRGCATASWCQGSHV
ADSFPTHLNVSVSCCHGSGCNSPTGGSHHHHHHGGSGLNDIFEAQKIEWH
E Human uPA-His-AviTag fusion
(SEQ ID NO: 261)
MYRMQLLSCIALSLALVTNSSNELHQVPSNCDCLNGGTCVSNKYFSNIHW
CNCPKKFGGQHCEIDKSKTCYEGNGHFYRGKASTDTMGRPCLPWNSATVL
QQTYHAHRSDALQLGLGKHNYCRNPDNRRRPWCYVQVGLKPLVQECMVHD
CAGGSHHHHHHGGSGLNDIFEAQKIEWHE Mouse uPA-His-AviTag fusion
(SEQ ID NO: 262)
MYRMQLLSCIALSLALVTNSGSVLGAPDESNCGCQNGGVCVSYKYFSRIR
RCSCPRKFQGEHCEIDASKTCYHGNGDSYRGKANTDTKGRPCLAWNAPAV
LQKPYNAHRPDAISLGLGKHNYCRNPDNQKRPWCYVQIGLRQFVQECMVH
DCGGSHHHHHHGGSGLNDIFEAQKIEWHE Antibodies designated M1, M5, M8, and M43 each bound human uPAR independent of the ligand uPA and were selected for further characterization.

The heavy chain variable domain (VH) and light chain variable domain (VL) amino acid sequences and HCDR1-3 and LCDR1-3 amino acid sequences for M1, M5, M8, and M43 are recited below in Table 3.

TABLE 3

Parental Antibody Sequences

| Sequence ID | Sequence |
|---|---|
| M1 VH | EVQLQQSGAELVRPGASVKLSCTASGFNIKDEYINWVKQRPEQGL EWIGWIDPENGDTEYASKFQGKATITADTSSNTAYLQLSSLTSEDT AVYYCTGGNYVGWFPYWGQGTLVTVSA (SEQ ID NO: 1) |
| M1 VL | QIVLTQSPAIMSASPGEKVTMTCSASSSVSYMHWYQQKSGTSPKR WLYDTSKLASGVPARFSGSGSGTSYSLTISSMEAEDAATYYCQQW SSNPPYTFGGGTKLEIK (SEQ ID NO: 2) |
| M1 HCDR1 | GFNIKDEY (SEQ ID NO: 3) |
| M1 HCDR2 | IDPENGDT (SEQ ID NO: 4) |
| M1 HCDR3 | TGGNYVGWFPY (SEQ ID NO: 5) |

TABLE 3-continued

Parental Antibody Sequences

| Sequence ID | Sequence |
|---|---|
| M1 LCDR1 | SSVSY (SEQ ID NO: 6) |
| M1 LCDR2 | DTS (SEQ ID NO: 7) |
| M1 LCDR3 | QQWSSNPPY (SEQ ID NO: 8) |
| M5 VH | QVQLKESGPGLVAPSQSLSITCTVSGFSLTNYGVHWVRQPPGKDL EWLVVIWSDGGTTYNSALKSRLSISKDNSKSQVFLKMNSLQTDDT AMYYCARGGRSDLFAYWGQGTLVTVSA (SEQ ID NO: 9) |
| M5 VL | DVLMTQTPLSLPVSLGDQASISCRSSQSIVHSNGNTYLEWYLQKPG QSPKLLIYKVSNRFSGVPDRFSGSGSGTDFTLKISRVEAEDLGVYY CFQGSHVPYTFGGGTKLEIK (SEQ ID NO: 10) |
| M5 HCDR1 | GFSLTNYG (SEQ ID NO: 11) |
| M5 HCDR2 | IWSDGGT (SEQ ID NO: 12) |
| M5 HCDR3 | ARGGRSDLFAY (SEQ ID NO: 13) |
| M5 LCDR1 | QSIVHSNGNTY (SEQ ID NO: 14) |
| M5 LCDR2 | KVS (SEQ ID NO: 15) |
| M5 LCDR3 | FQGSHVPYT (SEQ ID NO: 16) |
| M8 VH | QIQLVQSGPELKKPGETVKISCKASGNTFTDYGMNWVKQSPGKG LKWMGWINTNTGEPTYADDFKGRFAFSLETSASTAYLQINNLKNE DMATYFCAHYSFDYWGQGTTLTVSS (SEQ ID NO: 17) |
| M8 VL | DIQMTQSPASLSVSVGQTVTITCRTSENIYSNLAWYQQKPGKSPQL LVYAATNLADGVPSRFSGSGSGTQYSLKINSLQSEDFGSYYCQHF WGTPWTFGGGTKLEIK (SEQ ID NO: 18) |
| M8 HCDR1 | GNTFTDYG (SEQ ID NO: 19) |
| M8 HCDR2 | INTNTGEP (SEQ ID NO: 20) |
| M8 HCDR3 | AHYSFDY (SEQ ID NO: 21) |
| M8 LCDR1 | ENIYSN (SEQ ID NO: 22) |
| M8 LCDR2 | AAT (SEQ ID NO: 23) |
| M8 LCDR3 | QHFWGTPWT (SEQ ID NO: 24) |
| M43 VH | QVQLQQSGAELARPGASVNLSCKASGYTFTSYGISWVKQRTGQG LEWIGEIYPRSGNTYYNEKFKGKATLTADKSSRTAYMELRSLTSE DSAVYFCAGKDYGSTYADYWGQGTTLTVSS (SEQ ID NO: 25) |
| M43 VL | QIVLTQSPAIMSASPGEKVTMTCSASSSVSSRYLHWYQQKSGASP KLWIYGTSNLASGVPARFSGSGSGTSYSLTINSVEAEDAATYYCQ QYHSDPLTFGAGTKLELK (SEQ ID NO: 26) |
| M43 HCDR1 | GYTFTSYG (SEQ ID NO: 27) |
| M43 HCDR2 | IYPRSGNT (SEQ ID NO: 28) |
| M43 HCDR3 | AGKDYGSTYADY (SEQ ID NO: 29) |
| M43 LCDR1 | SSVSSRY (SEQ ID NO: 30) |
| M43 LCDR2 | GTS (SEQ ID NO: 31) |
| M43 LCDR3 | QQYHSDPLT (SEQ ID NO: 32) |

The binding affinity of anti-uPAR antibodies M1, M5, M8, and M43 was determined. Binding affinity analysis was carried out using the Octet platform based on bio-layer interferometry (BLI) technology. Briefly, uPAR antibodies were immobilized via an Anti-mouse Fc (AMC) sensor. Each uPAR antibody was tested at a concentration of 10 μg/mL. The load was histidine-tagged human uPAR (Sino #10925-H08H). A bare sensor was used as a control. The binding affinities of each antibody against human uPAR are recited below in Table 4.

TABLE 4

Parental Antibody Binding Affinity Data

| uPAR Antibody | KD (M) | k on(1/Ms) | k dis(1/s) | Full R² |
|---|---|---|---|---|
| M8 | 1.08E−09 | 5.84E+05 | 6.30E−04 | 0.994079 |
| M43 | 7.47E−09 | 1.18E+06 | 8.83E−03 | 0.998659 |
| M1 | 5.11E−10 | 6.64E+05 | 3.40E−04 | 0.999416 |
| M5 | 3.31E−08 | 2.91E+04 | 9.62E−04 | 0.983345 |

An additional binding affinity analysis was carried out using the Octet platform with histidine-tagged human uPAR immobilized on a sensor at a concentration of 10 µg/mL. The load was each of M1, M5, M8, and M43. A bare sensor was used as a control. The binding affinities of each antibody against human uPAR when human uPAR was immobilized are recited below in Table 5. Each antibody showed less than 1 pM binding affinity, suggesting avidity effects.

TABLE 5

Binding Affinity Data

| uPAR Antibody | KD (M) | k on(1/Ms) | k dis(1/s) | Full R² |
|---|---|---|---|---|
| M8 | <1.0E−12 | 3.11E+05 | <1.0E−07 | 0.985572 |
| M43 | <1.0E−12 | 5.54E+05 | <1.0E−07 | 0.990357 |
| M1 | <1.0E−12 | 4.48E+05 | <1.0E−07 | 0.982889 |
| M5 | <1.0E−12 | 2.83E+04 | <1.0E−07 | 0.985581 |

The uPAR binding epitopes for each antibody were characterized using the Octet platform recited above. Biotinylated human uPAR variant, uPAR DII-DIII domain or uPAR DIII domain, were captured by an SA sensor at 10 µg/ml for 180 seconds, followed by binding of M1, M5, M8, M43 or ATN 568 for 150 seconds at a concentration of 200 nM. The following amino acid sequences were used for the DII-DIII domain and DIII domain:

```
Human uPAR DII-DIII domain HisAvi Tag
                             (SEQ ID NO: 263)
MYRMQLLSCIALSLALVTNSGNSGRAVTYSRSRYLECISCGSSDMSCERG

RHQSLQCRSPEEQCLDVVTHWIQEGEEGRPKDDRHLRGCGYLPGCPGSNG

FHNNDTFHFLKCCNTTKCNEGPILELENLPQNGRQCYSCKGNSTHGCSSE

ETFLIDCRGPMNQCLVATGTHEPKNQSYMVRGCATASMCQHAHLGDAFSM

NHIDVSCCTKSGCNHPDLDVQYRGGSHHHHHGGSGLNDIFEAQKIEWHE

Human uPAR DIII domain HisAvi Tag
                             (SEQ ID NO: 264)
MYRMQLLSCIALSLALVTNSGPILELENLPQNGRQCYSCKGNSTHGCSSE

ETFLIDCRGPMNQCLVATGTHEPKNQSYMVRGCATASMCQHAHLGDAFSM

NHIDVSCCTKSGCNHPDLDVQYRGGSHHHHHGGSGLNDIFEAQKIEWHE
```

Figure 1B:
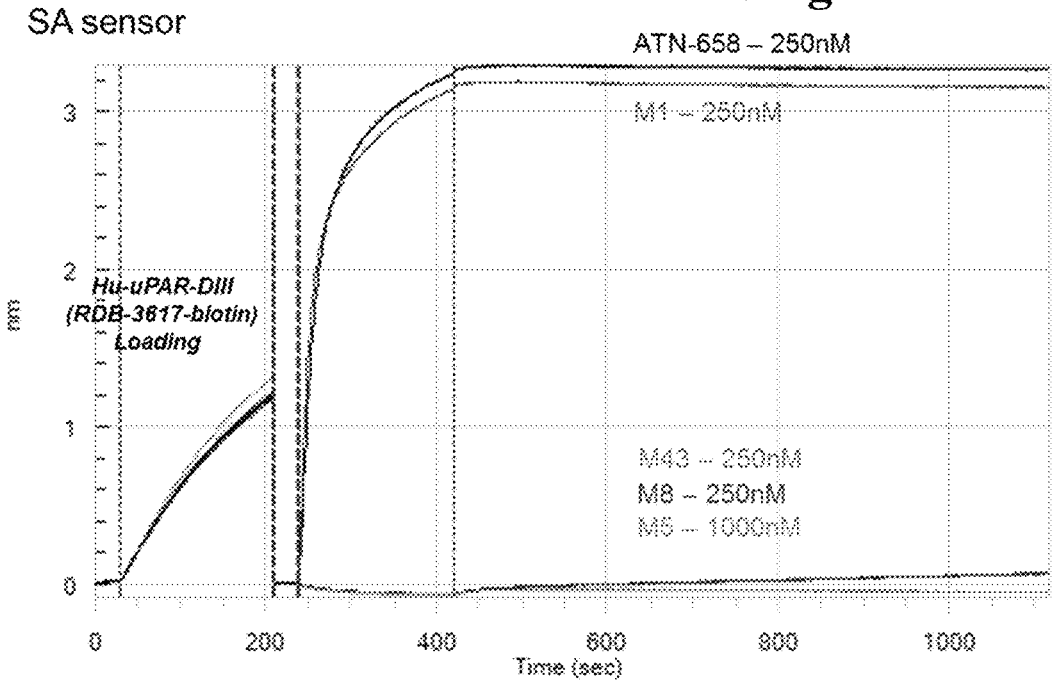

M1, M5, M8, and M43 bind to the DII-DIII domain of human uPAR, while M1 is capable of binding DIII alone as well (FIG. 1A, FIG. 1B). Each of M1, M5, M8, and M43 were found to bind to uPAR independent of uPA binding to uPAR, the uPAR ligand. The anti-uPAR antibody ATN-658 was used as a comparator.

To test antibody and uPA ligand competition binding, human uPA was captured by an SA sensor at 3.2 µg/ml (200 nM) for 45 seconds. Human recombinant protein uPAR-His was loaded at 100 nM for 180 seconds, followed by M1, M5, M8, M43 or ATN 568 for 150 seconds at a concentration of 200 nM.

An antibody competition assay was performed using the Octet platform. The antibody competition assay was performed by capturing biotinylated human uPAR on SA sensors. M1, M5, M8, M43 and ATN-658 were then loaded as the first ligand to bind human uPAR at a predetermined saturation concentration. Once saturation was reached by the first ligand, M1, M5, M8, M43, and ATN-568 was then loaded as the second ligand to compete against M1, M5, M8, M43 or ATN-658. The second ligand binding solution contained the same concentration of the first preload ligand to prevent its disassociation during second ligand binding. M1 was found to only compete with the comparator antibody, ATN-658. M5 competed against M43. None of M1, M8, or M43 competed for binding against each other to human uPAR, indicating that the three antibodies have unique epitopes to human uPAR (i.e., the antibodies are non-competitive). The matrix competition assay data is recited below in Table 6.

TABLE 6

Antibody Competition Summary Data.

| Antibody | M1 | M5 | M8 | M43 | ATN-368 | Buffer |
|---|---|---|---|---|---|---|
| M1 | −0.0441 | 0.1611 | 0.3019 | 0.3122 | −0.0144 | −0.0137 |
| M5 | 0.3646 | −0.0173 | 0.3211 | 0.0175 | 0.3865 | −0.0149 |
| ATN-368 | −0.0232 | 0.1793 | 0.3104 | 0.3421 | −0.0274 | −0.0053 |
| None | 0.3049 | 0.1809 | 0.2841 | 0.295 | 0.3304 | −0.0009 |

Values demonstrating competition are in bold.

Figure 2A:
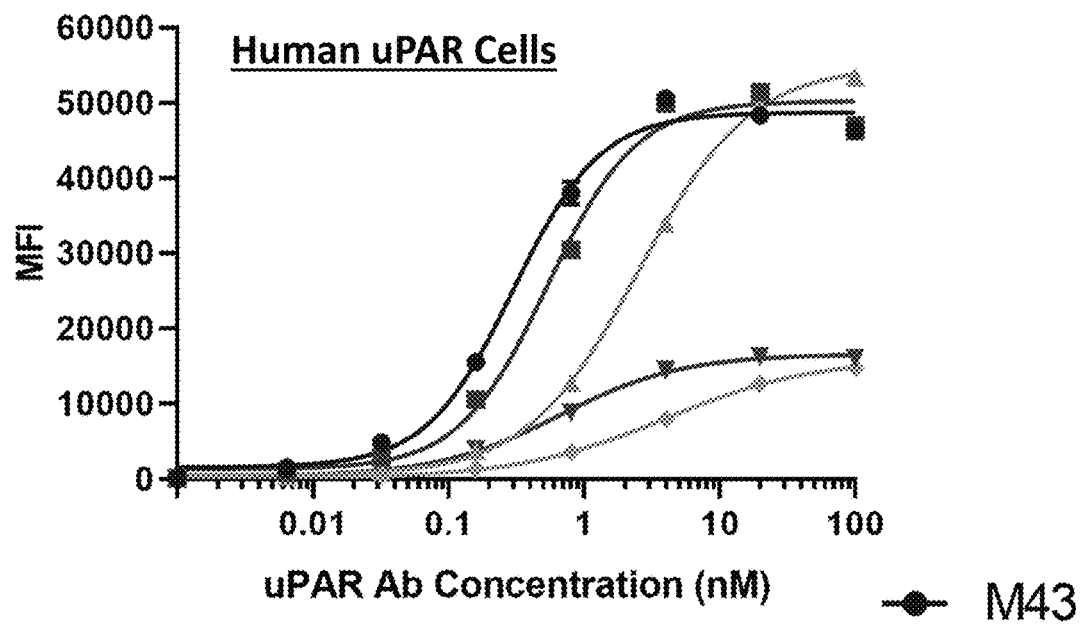
FIG. 2A-FIG. 2B depict anti-uPAR antibody binding data against human (FIG. 2A) and mouse (FIG. 2B) uPAR expressed on the surface of HEK 293 cells engineered to express human uPAR or mouse uPAR. The anti-uPAR antibodies were incubated with cells over a titration and median fluorescent intensity (MFI) values across the tested antibody concentrations were determined.
Figure 2B:
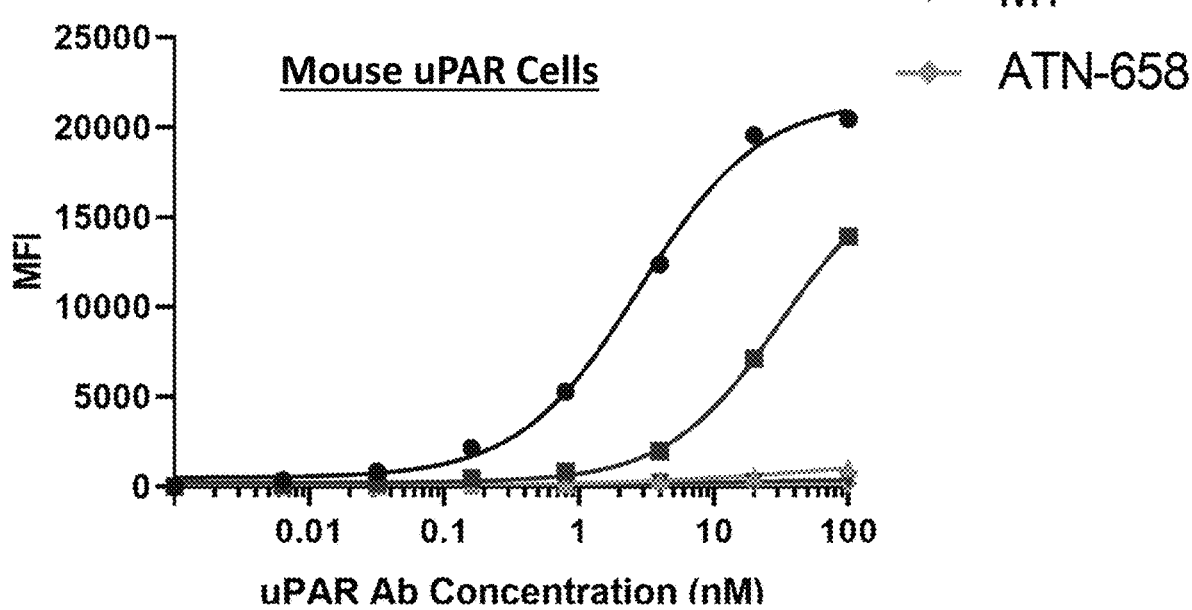

The antibodies were next tested for their ability to bind human and mouse uPAR expressed on the surface of cells. Human HEK293 cells engineered to express human uPAR or mouse uPAR were dye-labeled and mixed with unlabeled parental HEK293 cells. Cells were incubated with 100 nM each of human and mouse uPA (uPAR ligand) for 30 min and then treated with a titration of the uPAR antibodies for 30 min. uPAR antibody binding was detected using anti-mouse-IgG-phycoerythrin (PE)-labelled secondary antibody. Median fluorescent intensity (MFI) values across the tested antibody concentrations are show in FIG. 2A and FIG. 2B. The EC50 values are recited below in Table 7. EC50 values of cell binding without the uPA ligand were similar to experiments with the uPA ligand. M1, M5, M8, M43 EC50 binding values were all superior to the comparator ATN-658.

TABLE 7

EC50 values for anti-PAR antibodies in the cell-binding assay

| | EC50 (nM) | |
|---|---|---|
| Antibodies | Hu-uPAR | Ms-uPAR |
| M43 | 0.30 | 2.83 |
| M8 | 0.54 | 31.35 |
| M5 | 2.53 | 93.81 |
| M1 | 0.66 | — |
| ATN-658 | 3.99 | — |

Example 2—Humanization of Parental Anti-uPAR Antibodies

Anti-uPAR parental antibodies M1, M8, and M43 described above were carried forward for humanization. Various parameters for each antibody were first determined, including 1) the natural humanization percent identity of each mouse antibody to a human antibody sequence; 2) regions of immunogenicity (e.g., T-cell, B-cell, and MHC-II antigenicity epitopes); 3) antibody misfolding issues (e.g., aggregation and thermal stability); and 4) post-translational modifications (PTMs). The PTMs included deamidation sites (e.g., Asn-Gly (NG), causing an asparagine to aspartate/isoaspartate change), isomerization sites (e.g., Asp-Gly (DG), Asp/Asp (DD), causing an aspartate to isoaspartate change), glycosylation sites (e.g., Asn-X-Ser/Thr (NXS) amino acid motifs, where "X" is any amino acid, such as NLS), oxidation sites (e.g., Met and/or Trp amino acids, which may be surface exposed and/or in a CDR of the antibody), proteolysis sites (e.g., Asp-Ser (DS) and/or Asp-Pro (DP) amino acid motifs).

Humanized antibodies were then generated. The heavy chain variable domain (VH) and light chain variable domain (VL) amino acid sequences and HCDR1-3 and LCDR1-3 amino acid sequences are recited below in Table 8. The full-length heavy chain (HC) and light chain (LC) amino acid sequences, which include the constant region of the antibody, are recited below in Table 9. Single chain variable (scFv) format antibody amino acid sequences are recited below in Table 10.

TABLE 8

Humanized Antibody VH/VL & HCDR1-3/LCDR1-3 Amino Acid Sequences

| Sequence ID | Sequence |
|---|---|
| M1-H1 VH | EVQLVQSGAEVKKPGATVKISCTASGFNIKDEYINWVKQRPGKGL EWIGWIDPENGDTEYASKFQGRVTITADTSTDTAYLELSSLRSEDT AVYYCTGGNYVGWFPYWGQGTLVTVSS (SEQ ID NO: 33) |
| M1-H3 VH | EVQLQQSGAEVKKPGATVKLSCTASGFNIKDEYINWVKQRPGQG LEWIGWIDPENGDTEYASKFQGRATITADTSTDTAYLELSSLRSED TAVYYCTGGNYVGWFPYWGQGTLVTVSS (SEQ ID NO: 34) |
| M1-L1 VL | EIVLTQSPATLSLSPGERATLSCSASSSVSYMHWYQQKPGTSPRRW IYDTSKLASGVPARFSGSGSGTDFTLTISSLEPEDFAVYYCQQWSS NPPYTFGQGTKLEIK (SEQ ID NO: 35) |
| M1-L4 VL | QIVLTQSPATLSASPGERVTMSCSASSSVSYMHWYQQKPGTSPRR WLYDTSKLASGVPARFSGSGSGTDYTLTISSLEPEDFATYYCQQW SSNPPYTFGQGTKLEIK (SEQ ID NO: 36) |
| M1-H1 & M1-H3 HCDR1 | GFNIKDEY (SEQ ID NO: 3) |
| M1-H1 & M1-H3 HCDR2 | IDPENGDT (SEQ ID NO: 4) |
| M1-H1 & M1-H3 HCDR3 | TGGNYVGWFPY (SEQ ID NO: 5) |
| M1-L1 & M1-L4 LCDR1 | SSVSY (SEQ ID NO: 6) |
| M1-L1 & M1-L4 LCDR2 | DTS (SEQ ID NO: 7) |
| M1-L1 & M1-L4 LCDR3 | QQWSSNPPY (SEQ ID NO: 8) |
| M8-H3 VH | QIQLVQSGSELKKPGASVKISCKASGTTFTDYGMNWVKQSPGKGL KWMGWINTNTGEPTYAEDFKGRFVFSLDTSVSTAYLQISSLKAED TATYFCAHYSFDYWGQGTLLTVSS (SEQ ID NO: 37) |
| M8-L2B2 VL | DIQMTQSPSSLSASVGDTVTITCRTSENIYSNLAWYQQKPGKSPQL LVYAATNLADGVPSRFSGSGSGTQYTLKISSLQPEDFATYYCQHF WGTPWTFGGGTKVEIK (SEQ ID NO: 38) |
| M8-L2B5 VL | DIQMTQSPSSLSASVGDRVTITCRTSENIYSNLAWYQQKPGKSPQL LVYAATNLADGVPSRFSGSGSGTDYTLTISSLQPEDFGTYYCQHF WGTPWTFGGGTKVEIK (SEQ ID NO: 39) |
| M8-L2B10 VL | DIQMTQSPSSLSASVGDTVTITCRTSENIYSNLAWYQQKPGKSPQL LVYAATNLADGVPSRFSGSGSGTDYTLTISSLQPEDFGTYYCQHF WGTPWTFGGGTKVEIK (SEQ ID NO: 40) |
| M8-H3 HCDR1 | G<u>T</u>TFTDYG (SEQ ID NO: 41) |
| M8-H3 HCDR2 | INTNTGEP (SEQ ID NO: 20) |
| M8-H3 HCDR3 | AHYSFDY (SEQ ID NO: 21) |
| M8-L2B2, M8-L2B5, & M8-L2B10 LCDR1 | ENIYSN (SEQ ID NO: 22) |

TABLE 8-continued

Humanized Antibody VH/VL & HCDR1-3/LCDR1-3 Amino Acid Sequences

| Sequence ID | Sequence |
| --- | --- |
| M8-L2B2, M8-L2B5, & M8-L2B10 LCDR2 | AAT (SEQ ID NO: 23) |
| M8-L2B2, M8-L2B5, & M8-L2B10 LCDR3 | QHFWGTPWT (SEQ ID NO: 24) |
| M43-H1bm5 VH | QVQLVQSGAEVAKPGASVNLNCKASGYTFTSYGISWVRQRTGQG LEWIGEIYPRSGNTYYNEKFKGKVTLTTDKSTRTAYMELRSLTSE DTAVYYCAGKDYGSTYADYWGQGTTLTVSS (SEQ ID NO: 42) |
| M43-H4bm5 VH | QVQLQQSGAEVAKPGASVNLNCKASGYTFTSYGISWVRQRTGQG LEWIGEIYPRSGNTYYNEKFKGKATLTADKSTRTAYMELRSLTSE DTAVYFCAGKDYGSTYADYWGQGTTLTVSS (SEQ ID NO: 43) |
| M43-L4 VL | QIVLTQSPATLSASPGERVTMTCSASSSVSSRYLHWYQQKSGASPR LWIYGTSNLASGVPARFSGSGPGTSYTLTISSVEPEDAATYYCQQY HSDPLTFGQGTKLELK (SEQ ID NO: 44) |
| M43-H1bm5 & M43-H4bm5 HCDR1 | GYTFTSYG (SEQ ID NO: 27) |
| M43-H1bm5 & M43-H4bm5 HCDR2 | IYPRSGNT (SEQ ID NO: 28) |
| M43-H1bm5 & M43-H4bm5 HCDR3 | AGKDYGSTYADY (SEQ ID NO: 29) |
| M43-L4 LCDR1 | SSVSSRY (SEQ ID NO: 30) |
| M43-L4 LCDR2 | GTS (SEQ ID NO: 31) |
| M43-L4 LCDR3 | QQYHSDPLT (SEQ ID NO: 32) |

TABLE 9

Humanized Antibody Full-Length Amino Acid Sequences

| Sequence ID | Sequence |
| --- | --- |
| M1-H1 HC | EVQLVQSGAEVKKPGATVKISCTASGFNIKDEYINWVKQRPGKGL EWIGWIDPENGDTEYASKFQGRVTITADTSTDTAYLELSSLRSEDT AVYYCTGGNYVGWFPYWGQGTLVTVSSASTKGPSVFPLAPSSKS TSGGTAALGCLVKDYFPEPVTVSWNSGALTSGVHTFPAVLQSSGL YSLSSVVTVPSSSLGTQTYICNVNHKPSNTKVDKKVEPKSCDKTH TCPPCPAPEAAGGPSVFLFPPKPKDTLMISRTPEVTCVVVDVSHED PEVKFNWYVDGVEVHNAKTKPREEQYNSTYRVVSVLTVLHQDW LNGKEYKCKVSNKALPAPIEKTISKAKGQPREPQVYTLPPSRDELT KNQVSLTCLVKGFYPSDIAVEWESNGQPENNYKTTPPVLDSDGSF FLYSKLTVDKSRWQQGNVFSCSVMHEALHNHYTQKSLSLSPGK (SEQ ID NO: 45) |
| M1-H3 HC | EVQLQQSGAEVKKPGATVKLSCTASGFNIKDEYINWVKQRPGQG LEWIGWIDPENGDTEYASKFQGRATITADTSTDTAYLELSSLRSED TAVYYCTGGNYVGWFPYWGQGTLVTVSSASTKGPSVFPLAPSSK STSGGTAALGCLVKDYFPEPVTVSWNSGALTSGVHTFPAVLQSSG LYSLSSVVTVPSSSLGTQTYICNVNHKPSNTKVDKKVEPKSCDKT HTCPPCPAPEAAGGPSVFLFPPKPKDTLMISRTPEVTCVVVDVSHE DPEVKFNWYVDGVEVHNAKTKPREEQYNSTYRVVSVLTVLHQD WLNGKEYKCKVSNKALPAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSPG K (SEQ ID NO: 46) |

TABLE 9-continued

Humanized Antibody Full-Length Amino Acid Sequences

| Sequence ID | Sequence |
|---|---|
| M1-L1 LC | EIVLTQSPATLSLSPGERATLSCSASSSVSYMHWYQQKPGTSPRRW IYDTSKLASGVPARFSGSGSGTDFTLTISSLEPEDFAVYYCQQWSS NPPYTFGQGTKLEIKTVAAPSVFIFPPSDEQLKSGTASVVCLLNNF YPREAKVQWKVDNALQSGNSQESVTEQDSKDSTYSLSSTLTLSKA DYEKHKVYACEVTHQGLSSPVTKSFNRGEC (SEQ ID NO: 47) |
| M1-L1 LC variant | EIVLTQSPATLSLSPGERATLSCSASSSVSYMHWYQQKPGTSPRRW IYDTSKLASGVPARFSGSGSGTDFTLTISSLEPEDFAVYYCQQWSS NPPYTFGQGTKLEIKRTVAAPSVFIFPPSDEQLKSGTASVVCLLNNF YPREAKVQWKVDNALQSGNSQESVTEQDSKDSTYSLSSTLTLSKA DYEKHKVYACEVTHQGLSSPVTKSFNRGEC (SEQ ID NO: 159) |
| M1-L4 LC | QIVLTQSPATLSASPGERVTMSCSASSSVSYMHWYQQKPGTSPRR WLYDTSKLASGVPARFSGSGSGTDYTLTISSLEPEDFATYYCQQW SSNPPYTFGQGTKLEIKTVAAPSVFIFPPSDEQLKSGTASVVCLLNN FYPREAKVQWKVDNALQSGNSQESVTEQDSKDSTYSLSSTLTLSK ADYEKHKVYACEVTHQGLSSPVTKSFNRGEC (SEQ ID NO: 48) |
| M1-L4 LC variant | QIVLTQSPATLSASPGERVTMSCSASSSVSYMHWYQQKPGTSPRR WLYDTSKLASGVPARFSGSGSGTDYTLTISSLEPEDFATYYCQQW SSNPPYTFGQGTKLEIKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC (SEQ ID NO: 160) |
| M8-H3 HC | QIQLVQSGSELKKPGASVKISCKASGTTFTDYGMNWVKQSPGKGL KWMGWINTNTGEPTYAEDFKGRFVFSLDTSVSTAYLQISSLKAED TATYFCAHYSFDYWGQGTLLTVSSASTKGPSVFPLAPSSKSTSGGT AALGCLVKDYFPEPVTVSWNSGALTSGVHTFPAVLQSSGLYSLSS VVTVPSSSLGTQTYICNVNHKPSNTKVDKKVEPKSCDKTHTCPPC PAPEAAGGPSVFLFPPKPKDTLMISRTPEVTCVVVDVSHEDPEVKF NWYVDGVEVHNAKTKPREEQYNSTYRVVSVLTVLHQDWLNGKE YKCKVSNKALPAPIEKTISKAKGQPREPQVYTLPPSRDELTKNQVS LTCLVKGFYPSDIAVEWESNGQPENNYKTTPPVLDSDGSFFLYSKL TVDKSRWQQGNVFSCSVMHEALHNHYTQKSLSLSPGK (SEQ ID NO: 49) |
| M8-L2B2 LC | DIQMTQSPSSLSASVGDTVTITCRTSENIYSNLAWYQQKPGKSPQL LVYAATNLADGVPSRFSGSGSGTQYTLKISSLQPEDFATYYCQHF WGTPWTFGGGTKVEIKTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC (SEQ ID NO: 50) |
| M8-L2B2 LC Variant | DIQMTQSPSSLSASVGDTVTITCRTSENIYSNLAWYQQKPGKSPQL LVYAATNLADGVPSRFSGSGSGTQYTLKISSLQPEDFATYYCQHF WGTPWTFGGGTKVEIKRTVAAPSVFIFPPSDEQLKSGTASVVCLL NNFYPREAKVQWKVDNALQSGNSQESVTEQDSKDSTYSLSSTLTL SKADYEKHKVYACEVTHQGLSSPVTKSFNRGEC (SEQ ID NO: 161) |
| M8-L2B5 LC | DIQMTQSPSSLSASVGDRVTITCRTSENIYSNLAWYQQKPGKSPQL LVYAATNLADGVPSRFSGSGSGTDYTLTISSLQPEDFGTYYCQHF WGTPWTFGGGTKVEIKTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC (SEQ ID NO: 51) |
| M8-L2B5 LC Variant | DIQMTQSPSSLSASVGDRVTITCRTSENIYSNLAWYQQKPGKSPQL LVYAATNLADGVPSRFSGSGSGTDYTLTISSLQPEDFGTYYCQHF WGTPWTFGGGTKVEIKRTVAAPSVFIFPPSDEQLKSGTASVVCLL NNFYPREAKVQWKVDNALQSGNSQESVTEQDSKDSTYSLSSTLTL SKADYEKHKVYACEVTHQGLSSPVTKSFNRGEC (SEQ ID NO: 162) |
| M8-L2B10 LC | DIQMTQSPSSLSASVGDTVTITCRTSENIYSNLAWYQQKPGKSPQL LVYAATNLADGVPSRFSGSGSGTDYTLTISSLQPEDFGTYYCQHF WGTPWTFGGGTKVEIKTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC (SEQ ID NO: 52) |
| M8-L2B10 LC Variant | DIQMTQSPSSLSASVGDTVTITCRTSENIYSNLAWYQQKPGKSPQL LVYAATNLADGVPSRFSGSGSGTDYTLTISSLQPEDFGTYYCQHF WGTPWTFGGGTKVEIKRTVAAPSVFIFPPSDEQLKSGTASVVCLL NNFYPREAKVQWKVDNALQSGNSQESVTEQDSKDSTYSLSSTLTL SKADYEKHKVYACEVTHQGLSSPVTKSFNRGEC (SEQ ID NO: 163) |

TABLE 9-continued

Humanized Antibody Full-Length Amino Acid Sequences

| Sequence ID | Sequence |
|---|---|
| M43-H1bm5 HC | QVQLVQSGAEVAKPGASVNLNCKASGYTFTSYGISWVRQRTGQG<br>LEWIGEIYPRSGNTYYNEKFKGKVTLTTDKSTRTAYMELRSLTSE<br>DTAVYYCAGKDYGSTYADYWGQGTTLTVSSASTKGPSVFPLAPS<br>SKSTSGGTAALGCLVKDYFPEPVTVSWNSGALTSGVHTFPAVLDS<br>SGLYSLSSVVTVPSSSLGTQTYICNVNHKPSNTKVDKKVEPKSCD<br>KTHTCPPCPAPEAAGGPSVFLFPPKPKDTLMISRTPEVTCVVVDVS<br>HEDPEVKFNWYVDGVEVHNAKTKPREEQYNSTYRVVSVLTVLH<br>QDWLNGKEYKCKVSNKALPAPIEKTISKAKGQPREPQVYTLPPSR<br>DELTKNQVSLTCLVKGFYPSDIAVEWESNGQPENNYKTTPPVLDS<br>DGSFFLYSKLTVDKSRWQQGNVFSCSVMHEALHNHYTQKSLSLS<br>PGK (SEQ ID NO: 53) |
| M43-H4bm5 HC | QVQLQQSGAEVAKPGASVNLNCKASGYTFTSYGISWVRQRTGQG<br>LEWIGEIYPRSGNTYYNEKFKGKATLTADKSTRTAYMELRSLTSE<br>DTAVYFCAGKDYGSTYADYWGQGTTLTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKKVEPKSCDK<br>THTCPPCPAPEAAGGPSVFLFPPKPKDTLMISRTPEVTCVVVDVSH<br>EDPEVKFNWYVDGVEVHNAKTKPREEQYNSTYRVVSVLTVLHQ<br>DWLNGKEYKCKVSNKALPAPIEKTISKAKGQPREPQVYTLPPSRD<br>ELTKNQVSLTCLVKGFYPSDIAVEWESNGQPENNYKTTPPVLDSD<br>GSFFLYSKLTVDKSRWQQGNVFSCSVMHEALHNHYTQKSLSLSP<br>GK (SEQ ID NO: 54) |
| M43-L4 LC | QIVLTQSPATLSASPGERVTMTCSASSSVSSRYLHWYQQKSGASPR<br>LWIYGTSNLASGVPARFSGSGPGTSYTLTISSVEPEDAATYYCQQY<br>HSDPLTFGQGTKLELKTVAAPSVFIFPPSDEQLKSGTASVVCLLNN<br>FYPREAKVQWKVDNALQSGNSQESVTEQDSKDSTYSLSSTLTLSK<br>ADYEKHKVYACEVTHQGLSSPVTKSFNRGEC (SEQ ID NO: 55) |
| M43-L4LC Variant | QIVLTQSPATLSASPGERVTMTCSASSSVSSRYLHWYQQKSGASPR<br>LWIYGTSNLASGVPARFSGSGPGTSYTLTISSVEPEDAATYYCQQY<br>HSDPLTFGQGTKLELKRTVAAPSVFIFPPSDEQLKSGTASVVCLLN<br>NFYPREAKVQWKVDNALQSGNSQESVTEQDSKDSTYSLSSTLTLS<br>KADYEKHKVYACEVTHQGLSSPVTKSFNRGEC (SEQ ID NO: 164) |

TABLE 10

ScFv Antibody Amino Acid Sequences

| Sequence ID | Sequence |
|---|---|
| M1 ScFv (vH1-vL4) | EVQLVQSGAEVKKPGATVKISCTASGFNIKDEYINWVKQRPGKGLEW<br>IGWIDPENGDTEYASKFQGRVTITADTSTDTAYLELSSLRSEDTAVYY<br>CTGGNYVGWFPYWGQGTLVTVSSGGGGSGGGGSGGGGSQIVLTQSP<br>ATLSASPGERVTMSCSASSSVSYMHWYQQKPGTSPRRWLYDTSKLAS<br>GVPARFSGSGSGTDYTLTISSLEPEDFATYYCQQWSSNPPYTFGQGTK<br>LEIK (SEQ ID NO: 56) |
| M1 ScFv (vL4-vH1) | QIVLTQSPATLSASPGERVTMSCSASSSVSYMHWYQQKPGTSPRRWL<br>YDTSKLASGVPARFSGSGSGTDYTLTISSLEPEDFATYYCQQWSSNPP<br>YTFGQGTKLEIKGGGGSGGGGSGGGGSEVQLVQSGAEVKKPGATVKI<br>SCTASGFNIKDEYINWVKQRPGKGLEWIGWIDPENGDTEYASKFQGR<br>VTITADTSTDTAYLELSSLRSEDTAVYYCTGGNYVGWFPYWGQGTL<br>VTVSS (SEQ ID NO: 57) |
| M1 ScFv (vH3-vL1) | EVQLQQSGAEVKKPGATVKLSCTASGFNIKDEYINWVKQRPGQGLE<br>WIGWIDPENGDTEYASKFQGRATITADTSTDTAYLELSSLRSEDTAVY<br>YCTGGNYVGWFPYWGQGTLVTVSSGGGGSGGGGSGGGGSEIVLTQS<br>PATLSLSPGERATLSCSASSSVSYMHWYQQKPGTSPRRWIYDTSKLAS<br>GVPARFSGSGSGTDFTLTISSLEPEDFAVYYCQQWSSNPPYTFGQGTK<br>LEIK (SEQ ID NO: 58) |
| M1 ScFv (vL1-vH3) | EIVLTQSPATLSLSPGERATLSCSASSSVSYMHWYQQKPGTSPRRWIY<br>DTSKLASGVPARFSGSGSGTDFTLTISSLEPEDFAVYYCQQWSSNPPY<br>TFGQGTKLEIKGGGGSGGGGSGGGGSEVQLQQSGAEVKKPGATVKL<br>SCTASGFNIKDEYINWVKQRPGQGLEWIGWIDPENGDTEYASKFQGR<br>ATITADTSTDTAYLELSSLRSEDTAVYYCTGGNYVGWFPYWGQGTL<br>VTVSS (SEQ ID NO: 59) |
| M1 ScFv (vH3-vL4) | EVQLQQSGAEVKKPGATVKLSCTASGFNIKDEYINWVKQRPGQGLE<br>WIGWIDPENGDTEYASKFQGRATITADTSTDTAYLELSSLRSEDTAVY<br>YCTGGNYVGWFPYWGQGTLVTVSSGGGGSGGGGSGGGGSQIVLTQS |

TABLE 10-continued

ScFv Antibody Amino Acid Sequences

| Sequence ID | Sequence |
|---|---|
| | PATLSASPGERVTMSCSASSSVSYMHWYQQKPGTSPRRWLYDTSKLA<br>SGVPARFSGSGSGTDYTLTISSLEPEDFATYYCQQWSSNPPYTFGQGT<br>KLEIK (SEQ ID NO: 60) |
| M1 ScFv<br>(vL4-vH3) | QIVLTQSPATESASPGERVTMSCSASSSVSYMHWYQQKPGTSPRRWL<br>YDTSKLASGVPARFSGSGSGTDYTLTISSLEPEDFATYYCQQWSSNPP<br>YTFGQGTKLEIKGGGGSGGGGSGGGGSEVQLQQSGAEVKKPGATVK<br>LSCTASGFNIKDEYINWVKQRPGQGLEWIGWIDPENGDTEYASKFQG<br>RATITADTSTDTAYLELSSLRSEDTAVYYCTGGNYVGWFPYWGQGTL<br>VTVSS (SEQ ID NO: 61) |
| M8 ScFv<br>(vH3-vL2B2) | QIQLVQSGSELKKPGASVKISCKASGTTFTDYGMNWVKQSPGKGLK<br>WMGWINTNTGEPTYAEDFKGRFVFSLDTSVSTAYLQISSLKAEDTAT<br>YFCAHYSFDYWGQGTLLTVSSGGGGSGGGGSGGGGSDIQMTQSPSSL<br>SASVGDTVTITCRTSENIYSNLAWYQQKPGKSPQLLVYAATNLADGV<br>PSRFSGSGSGTQYTLKISSLQPEDFATYYCQHFWGTPWTFGGGTKVEI<br>K (SEQ ID NO: 62) |
| M8 ScFv<br>(vL2B2-vH3) | DIQMTQSPSSLSASVGDTVTITCRTSENIYSNLAWYQQKPGKSPQLLV<br>YAATNLADGVPSRFSGSGSGTQYTLKISSLQPEDFATYYCQHFWGTP<br>WTFGGGTKVEIKGGGGSGGGGSGGGGSQIQLVQSGSELKKPGASVKI<br>SCKASGTTFTDYGMNWVKQSPGKGLKWMGWINTNTGEPTYAEDFK<br>GRFVFSLDTSVSTAYLQISSLKAEDTATYFCAHYSFDYWGQGTLLTVS<br>S (SEQ ID NO: 63) |
| M8 ScFv<br>(vH3-vL2B5) | QIQLVQSGSELKKPGASVKISCKASGTTFTDYGMNWVKQSPGKGLK<br>WMGWINTNTGEPTYAEDFKGRFVFSLDTSVSTAYLQISSLKAEDTAT<br>YFCAHYSFDYWGQGTLLTVSSGGGGSGGGGSGGGGSDIQMTQSPSSL<br>SASVGDRVTITCRTSENIYSNLAWYQQKPGKSPQLLVYAATNLADGV<br>PSRFSGSGSGTDYTLTISSLQPEDFGTYYCQHFWGTPWTFGGGTKVEI<br>K (SEQ ID NO: 64) |
| M8 ScFv<br>(vL2B5-vH3) | DIQMTQSPSSLSASVGDRVTITCRTSENIYSNLAWYQQKPGKSPQLLV<br>YAATNLADGVPSRFSGSGSGTDYTLTISSLQPEDFGTYYCQHFWGTP<br>WTFGGGTKVEIKGGGGSGGGGSGGGGSQIQLVQSGSELKKPGASVKI<br>SCKASGTTFTDYGMNWVKQSPGKGLKWMGWINTNTGEPTYAEDFK<br>GRFVFSLDTSVSTAYLQISSLKAEDTATYFCAHYSFDYWGQGTLLTVS<br>S (SEQ ID NO: 65) |
| M8 ScFv<br>(vH3-<br>vL2B10) | QIQLVQSGSELKKPGASVKISCKASGTTFTDYGMNWVKQSPGKGLK<br>WMGWINTNTGEPTYAEDFKGRFVFSLDTSVSTAYLQISSLKAEDTAT<br>YFCAHYSFDYWGQGTLLTVSSGGGGSGGGGSGGGGSDIQMTQSPSSL<br>SASVGDTVTITCRTSENIYSNLAWYQQKPGKSPQLLVYAATNLADGV<br>PSRFSGSGSGTDYTLTISSLQPEDFGTYYCQHFWGTPWTFGGGTKVEI<br>K (SEQ ID NO: 66) |
| M8 ScFv<br>(vL2B10-<br>vH3) | DIQMTQSPSSLSASVGDTVTITCRTSENIYSNLAWYQQKPGKSPQLLV<br>YAATNLADGVPSRFSGSGSGTDYTLTISSLQPEDFGTYYCQHFWGTP<br>WTFGGGTKVEIKGGGGSGGGGSGGGGSQIQLVQSGSELKKPGASVKI<br>SCKASGTTFTDYGMNWVKQSPGKGLKWMGWINTNTGEPTYAEDFK<br>GRFVFSLDTSVSTAYLQISSLKAEDTATYFCAHYSFDYWGQGTLLTVS<br>S(SEQIDNO: 67) |
| M43 ScFv<br>(vH1-vL4) | QVQLVQSGAEVAKPGASVNLNCKASGYTFTSYGISWVRQRTGQGLE<br>WIGEIYPRSGNTYYNEKFKGKVTLTTDKSTRTAYMELRSLTSEDTAV<br>YYCAGKDYGSTYADYWGQGTTLTVSSGGGGSGGGGSGGGGSQIVLT<br>QSPATLSASPGERVTMTCSASSSVSSRYLHWYQQKSGASPRLWIYGTS<br>NLASGVPARFSGSGPGTSYTLTISSVEPEDAATYYCQQYHSDPLTFGQ<br>GTKLELK (SEQ ID NO: 68) |
| M43 ScFv<br>(vL4-vH1) | QIVLTQSPATLSASPGERVTMTCSASSSVSSRYLHWYQQKSGASPRL<br>WIYGTSNLASGVPARFSGSGPGTSYTLTISSVEPEDAATYYCQQYHSD<br>PLTFGQGTKLELKGGGGSGGGGSGGGGSQVQLVQSGAEVAKPGASV<br>NLNCKASGYTFTSYGISWVRQRTGQGLEWIGEIYPRSGNTYYNEKFK<br>GKVTLTTDKSTRTAYMELRSLTSEDTAVYYCAGKDYGSTYADYWG<br>QGTTLTVSS (SEQ ID NO: 69) |
| M43 ScFv<br>(vH4-vL4) | QVQLQQSGAEVAKPGASVNLNCKASGYTFTSYGISWVRQRTGQGLE<br>WIGEIYPRSGNTYYNEKFKGKATLTADKSTRTAYMELRSLTSEDTAV<br>YFCAGKDYGSTYADYWGQGTTLTVSSGGGGSGGGGSGGGGSQIVLT<br>QSPATLSASPGERVTMTCSASSSVSSRYLHWYQQKSGASPRLWIYGTS<br>NLASGVPARFSGSGPGTSYTLTISSVEPEDAATYYCQQYHSDPLTFGQ<br>GTKLELK (SEQ ID NO: 70) |

TABLE 10-continued

ScFv Antibody Amino Acid Sequences

Sequence ID Sequence

M43 ScFv (vL4-vH4)  QIVLTQSPATLSASPGERVTMTCSASSSVSSRYLHWYQQKSGASPRL
WIYGTSNLASGVPARFSGSGPGTSYTLTISSVEPEDAATYYCQQYHSD
PLTFGQGTKLELKGGGGSGGGGSGGGGSQVQLQQSGAEVAKPGASV
NLNCKASGYTFTSYGISWVRQRTGQGLEWIGEIYPRSGNTYYNEKFK
GKATLTADKSTRTAYMELRSLTSEDTAVYFCAGKDYGSTYADYWGQ
GTTLTVSS (SEQ ID NO: 71)

The binding affinity of the humanized anti-uPAR antibodies M1, M8, and M43 was determined. Binding affinity analysis was carried out using the Octet platform as described above. Briefly, uPAR antibodies were immobilized via an Anti-human Fc (AHC) sensor. Each uPAR antibody was tested at a concentration of 10 μg/mL. The load was histidine-tagged human uPAR provided over a titration starting at 50 nM with subsequent 2-fold dilutions. The binding affinities of the tested humanized antibodies against human uPAR are recited below in Table 11. Notably, the humanized antibodies retained similar binding affinity to human uPAR compared to the parental antibodies.

TABLE 11

Humanized Antibody Binding Affinity Data

| Antibody | KD (M) | k on(1/Ms) | k dis(1/s) |
|---|---|---|---|
| M1 - Chimeric | 1.11E−09 | 6.29E+05 | 7.01E−04 |
| M1 - H1/L4 | 1.48E−09 | 6.65E+05 | 9.86E−04 |
| M1 - H3/L1 | 1.64E−09 | 6.77E+05 | 1.11E−03 |
| M1 - H3/L4 | 1.30E−09 | 6.86E+05 | 8.93E−04 |
| M8 - Chimeric | 1.79E−09 | 2.73E+05 | 4.90E−04 |
| M8 - H3/L2B2 | 1.74E−09 | 2.46E+05 | 4.27E−04 |
| M8 - H3/L2B5 | 1.65E−09 | 2.13E+05 | 3.51E−04 |
| M8 - H3/L2B10 | 2.35E−09 | 2.03E+05 | 4.77E−04 |
| M43 - Chimeric | 1.51E−08 | 4.02E+05 | 6.06E−03 |
| M43 - H1bm5/L4 | 1.59E−08 | 4.15E+05 | 6.58E−03 |
| M43 - H4bm5/L4 | 1.47E−08 | 4.54E+05 | 6.66E−03 |

Example 3—Interleukin 12 (IL-12) Engineering

IL-12 is a heterodimeric cytokine composed of a p35 subunit and a p40 subunit, which associate to form IL-12p70. IL-12 is expressed by antigen presenting cells and plays multiple roles in the immuno-oncology lifecycle. IL-12 is a potent stimulator of the immune response, but toxicity issues have limited IL-12 use in the clinic. Localized delivery may reduce toxicity, but this precludes systemic delivery.

Engineering one or both of the p35 subunit and p40 subunit offers several advantages. A "Lock and Key" set of mutations can be made in each subunit to modulate affinity and enhance specificity between the two subunits. For example, mutations introduced into the engineered subunits may reduce recognition to the wild-type subunits, further reducing toxicity. Paired charge residues at the interface between p35 and p40 may be engineered to introduce specificity further specificity.

IL12p35/IL12p40 Cysteine Residue Engineering

Figure 3:
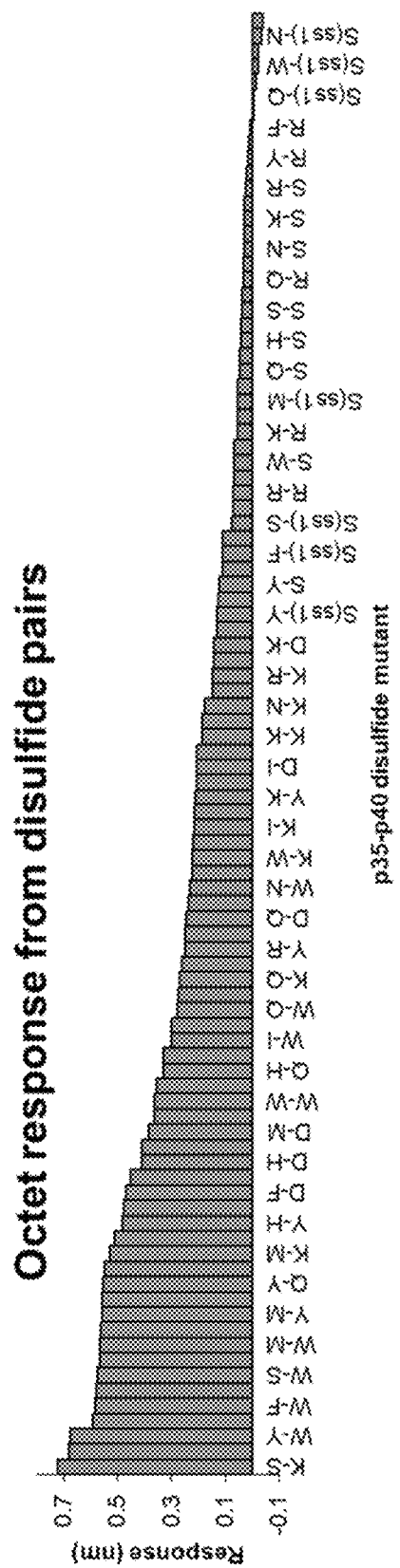
FIG. 3 depicts Octet binding data between p35 C74 variants and p40 C177 variants. Along the X-axis, the first amino acid recited for each data point corresponds to the p35 C74 substitution and the second amino acid recited for each data point corresponds to the p40 C177 substitution (i.e., the "K-S" data point is the binding affinity between a p35 C74K variant and a p40 C177S variant).
Figure 4A:
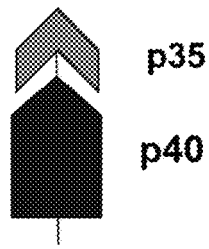
FIG. 4A-FIG. 4H depict schematics of several exemplary IL-12 subunit fusion proteins.
Figure 4B:
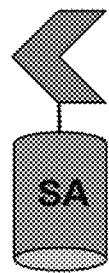
Figure 4C:
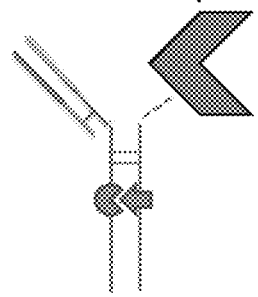
Figure 4D:
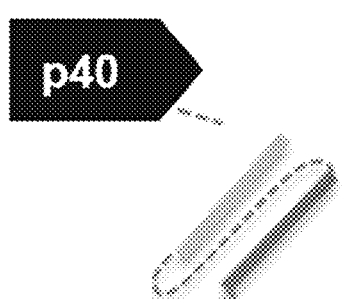
Figure 4E:
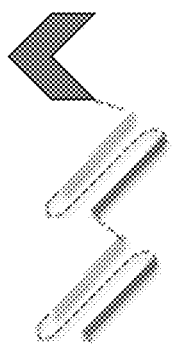
Figure 4F:
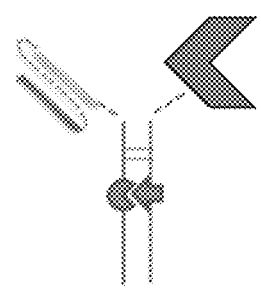
Figure 4G:
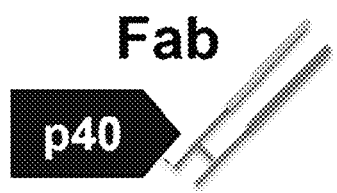
Figure 4H:
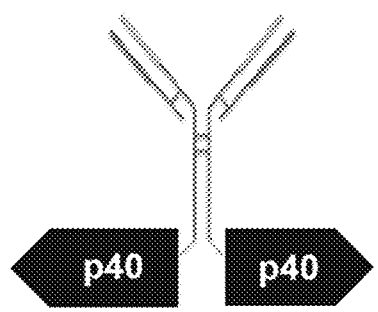

As part of an initial optimization strategy, several point mutations were identified in p35 and p40 to improve stability and expression. An intermolecular disulfide bridge was formed between C74 of p35 and C177 of p40. A screen was performed with amino acid substitutions at C74 of p35 and C177 of p40 to eliminate the disulfide bridge, while retaining or improving binding affinity between the two subunits. For p35, substitutions C74S, S(SS1), D, K, R, Q, W, and Y were generated. For p40, substitutions C177S, H, M, F, Y, R, K, E, Q, I, W, and N were generated. S(SS1) corresponds to a C15S, C88S, and C74S substitution in p35. The C15S/C88S pair removes in internal disulfide bridge. Each p35 C74 variant was then tested against each of the p40 C177 variants. Binding affinity was measure using the Octet platform described above. Briefly, a sensor was loaded with 5-10 μg/mL of either p35 or p40. A capture compound was provided at a concentration range of 500 nM to 7.8 nM. As shown in FIG. 3, several p35/p40 variant pairs demonstrated high binding affinity.

Select p35/p40 variant pairs were chosen for further binding affinity characterization. Specifically, a p35 C74D, K, W, and Y variant was paired with either a p40 C177S or C177F variant. The full binding affinity data is recited below in Tables 12 and 13. As shown below, each p35/p40 variant pair displayed high binding affinity.

TABLE 12 p40 C177S Binding Affinity To p35 C74D, K, W, and Y

| P35 C74 Sub. | KD (M) | KD error | Kon (1/Ms) | Kon error | Kdis (1/s) | Kdis error |
|---|---|---|---|---|---|---|
| D | 5.71E−08 | 3.92E−10 | 1.76E+04 | 1.05E+02 | 1.00E−03 | 3.36E−06 |
| K | 1.96E−08 | 1.39E−10 | 2.59E+04 | 1.18E+02 | 5.08E−04 | 2.78E−06 |
| W | 2.70E−08 | 2.49E−10 | 1.60E+04 | 9.85E+01 | 4.32E−04 | 2.97E−06 |
| Y | 2.32E−08 | 2.13E−10 | 1.77E+04 | 1.03E+02 | 4.11E−04 | 2.91E−06 |

TABLE 13 p40 C177F Binding Affinity To p35 C74D, K, W, and Y

| P35 C74 Sub. | KD (M) | KD error | Kon (1/Ms) | Kon error | Kdis (1/s) | Kdis error |
|---|---|---|---|---|---|---|
| D | 6.02E−08 | 5.34E−10 | 1.19E+04 | 9.13E+01 | 7.19E−04 | 3.23E−06 |
| K | 1.84E−08 | 1.34E−10 | 1.60E+04 | 6.15E+01 | 2.95E−04 | 1.82E−06 |
| W | 2.54E−08 | 2.15E−10 | 1.15E+04 | 5.85E+01 | 2.91E−04 | 1.96E−06 |
| Y | 2.38E−08 | 2.69E−10 | 1.25E+04 | 8.43E+01 | 2.98E−04 | 2.71E−06 |

In addition to the above recited disulfide bridge substitutions, a free thiol was identified in p40 (C252). This site was also engineered to a C252S substitution to remove the free thiol IL12p35/IL12p40 Engineering—Stability Enhancement While linking p35 and p40 to fusion partners can improve stability and production yield (see below), it would be advantageous to engineer the subunits to improve stability without a fusion partner. p35 in particular is unstable on its own, being aided significantly by a fusion partner or p40 for proper folding and expression.

At the outset, S27D and D188N mutations in p35 were identified via a directed molecular evolution approach (see, Leong et al. PNAS. 100(3): 1163-1168. 2003). The p35 substations are useful for increased yield.

Several surface exposed hydrophobic regions and flexible regions were identified on p35. An in silico modeling and simulation approach was used to identify potential amino acid mutations (i.e., substitutions, deletions, and/or insertions) that can improve p35 stability. As a first pass, 85 single point mutations were ranked by delta-delta G (ddG, i.e., the difference between delta G for the WT and mutant p35), solubility, position-specific scoring matrix (pssm) scores, and epitope prediction. The process attempted to introduce polar residues in place of solvent-exposed hydrophobic residues for better solubility and introduce bulky hydrophobic residues internally for better core-packing. Each single mutant was tested for expression and stability through western blot. Following western blot analysis, proteins were purified and tested by HPLC to determine % monomer and % aggregation. The point mutations tested by western blot are recited below in Table 14. Sample ID numbers 70-90 were p35-murine serum albumin (MSA) fusions. Sample ID numbers in bold italicized text (ID 72, 75, 76, 80, 82, 83) displayed the best expression among those tested, although all p35-MSA fusions expressed.

TABLE 14

Point Mutation(s) Tested For Expression By Western Blot

| Sample ID | Point Mutation(s) |
|---|---|
| 1 | M119L |
| 2 | M145L |
| 3 | M111L |
| 4 | M119Y |
| 5 | F150Y |
| 6 | M111W |
| 7 | V114I |
| 8 | M111F |
| 9 | M12R |
| 10 | M12S |
| 11 | S27D |
| 12 | Q35E/N28R |
| 13 | Q35E |
| 14 | S44K |
| 15 | V60E |
| 16 | T80K |
| 17 | T80R |
| 18 | K117R |
| 19 | N120D |
| 20 | K128Q |
| 21 | N136R |
| 22 | A139T |
| 23 | L161D |
| 24 | L161E |
| 25 | L161K |
| 26 | L161N |
| 27 | L161Q |
| 28 | L161S |
| 29 | K172R |
| 30 | S192N |
| 31 | A121K |
| 32 | M12Q |
| 33 | S27E |
| 34 | N28R |
| 35 | T80N |
| 36 | T80Q |
| 37 | A121N |
| 38 | K122R |
| 39 | A139Q |
| 40 | I171V |
| 41 | N21D |
| 42 | R24E |
| 43 | S27H |
| 44 | F39D |
| 45 | S103N |
| 46 | A139R |
| 47 | F132Y |
| 48 | S159E |
| 49 | R1D |
| 50 | N2D |
| 51 | A6E |
| 52 | A6H |
| 53 | A6Q |
| 54 | F39E |
| 55 | F39Y |
| 56 | F39H |
| 57 | F39K |
| 58 | F39N |
| 59 | S44E |
| 60 | K117E |
| 61 | E143R |
| 62 | N151D |
| 63 | S159Q |
| 64 | S159R |
| 65 | S81C/A99C |
| 66 | T59C/S104C |
| 67 | T80C/S103C |
| 68 | M29C/N136C |
| 69 | WT |
| 70 | WT-MSA |
| 71 | M12R |
| 72 | *M12S* |
| 73 | V60E |
| 74 | M111L |

TABLE 14-continued

Point Mutation(s) Tested For Expression By Western Blot

| Sample ID | Point Mutation(s) |
|---|---|
| 75 | *M111F* |
| 76 | *M111W* |
| 77 | M119L |
| 78 | M119Y |
| 79 | V114I |
| 80 | *M145L* |
| 81 | F150Y |
| 82 | *L161D* |
| 83 | *L161Q* |
| 84 | L161S |
| 85 | F39D |
| 86 | F39H |
| 87 | S27D |
| 88 | Q35E/N28R |
| 89 | T80K |
| 90 | S44K |

Following the western blot analysis, sample ID numbers 69-90 (p35-MSA fusions) were tested by HPLC to determine % monomer and % aggregate. The results are depicted below in Table 15, which shows that several p35 point mutants enjoyed greater % monomer content relative to the WT p35.

TABLE 15

Point Mutation(s) Tested For % Monomer And % Aggregate Content

| Mutant | Monomer % | Aggregate % |
|---|---|---|
| WT (no MSA) | 0 | 100 |
| WT-MSA | 5.84 | 94.16 |
| M12R | 3.92 | 96.08 |
| M12S | 5.36 | 94.64 |
| V60E | 4.35 | 95.65 |
| M111L | 0 | 100 |
| M111F | 8.88 | 91.12 |
| M111W | 9.73 | 90.27 |
| M119L | 5.55 | 94.45 |
| M119Y | 0 | 100 |
| V114I | 5.57 | 94.43 |
| M145L | 7.98 | 92.02 |
| F150Y | 5.97 | 94.03 |
| L161D | 5.67 | 94.33 |
| L161Q | 5.25 | 94.75 |
| L161S | 4.65 | 95.35 |
| F39D | 7.43 | 92.57 |
| F39H | 6.2 | 93.8 |
| S27D | 6.47 | 93.53 |
| Q35E/N28R | 7.1 | 92.9 |
| T80K | 0 | 100 |
| S44K | 7.59 | 92.41 |

The results of the single point mutant screen revealed several point mutations that improve p35 expression and stability. In particular, the following single p35 mutants displayed % monomer values that were similar to or exceeded the value for the WT p35-MSA fusion:

M12S, S27D, F39D, F39H, S44K, M111F, M111W, V114I, M119L, M145L, F150Y, L161D, L161Q.

A double mutant, Q35E/N28R, also displayed % monomer value that exceeded the value for the WT p35-MSA fusion.

Double mutations will be tested to further improve these parameters.

IL12p35/IL12p40 Fusions

IL-12 subunits p35 and p40 present several manufacturing challenges that should be overcome before IL-12 can be used as a viable therapeutic. p35 shows little to no expression. Expression can be improved by linking p35 to a fusion partner, such as an antibody or fragment thereof, or human serum albumin (HSA). p35 is also prone to aggregation. p40 shows similar challenges. p40 can be expresses without a fusion partner, but the purified composition is frequently contaminated with a p40 homodimer (about 15-20%). p40 is also prone to dimerization and aggregation over time at 37° C.

The p35 and p40 subunits were tested for stability at 37° C. with various fusion partners. p40 was tested with an antibody Fab fusion partner and a full-length IgG fusion partner, with two p40 subunits linked to each CH3 domain of the IgG molecule. The Fab and full-length antibodies were derived from anti-uPAR antibodies described above. p35 was tested with a mouse serum albumin (MSA) fusion partner and an CH1-hinge-CH2-CH3 antibody fragment fusion partner. A single chain IL-12 (scIL-12), where the p35 and p40 subunits are linked with an amino acid linker, was also tested. Exemplary IL-12 subunit fusion proteins are depicted in FIG. 4. Each fusion protein was tested by HPLC analysis to measure aggregate and dimer formation at 37° C. for 0 hours, 24 hours, 48 hours, 1 week, and 2 weeks. The results for each fusion protein are recited below in Table 16 to Table 21. The results demonstrate that linking the p35 and p40 subunits to various fusion partners can reduce aggregate and homodimer formation.

TABLE 16

| p40 subunit alone. Predicted Molecular Weight (Da) - 37087. | | | | |
|---|---|---|---|---|
| Time point | Calculated MW (Da) | interpolated Y value | Elution time (Vt) | % Area |
| 0 hours | 97198 | 4.988 | 4.601 | 19.1 |
| | 53816 | 4.731 | 5.090 | 80.9 |
| 24 hours | 1091167 | 6.038 | 3.051 | 9 |
| | 94812 | 4.977 | 4.589 | 56 |
| | 52814 | 4.723 | 5.070 | 35 |
| 48 hours | 1255456 | 6.099 | 3.017 | 13 |
| | 96647 | 4.985 | 4.603 | 58 |
| | 54541 | 4.737 | 5.086 | 29 |
| 1 week | 1793115 | 6.254 | 2.909 | 6 |
| | 97156 | 4.987 | 4.607 | 61 |
| | 54692 | 4.738 | 5.097 | 33 |
| 2 week | 95072 | 4.978 | 4.637 | 60 |
| | 52744 | 4.722 | 5.134 | 40 |

Bold values indicate the monomer. Other values represent aggregates and dimers. Differences in the predicted MW and calculated MW are due, in part, to protein glycosylation.

TABLE 17

| p40-Fab fusion. Predicted Molecular Weight (Da) - 62310. | | | | |
|---|---|---|---|---|
| Time point | Calculated MW (Da) | interpolated Y value | Elution time (Vt) | % Area |
| 0 hours | 171495 | 5.234 | 4.068 | 3.1 |
| | 94351 | 4.975 | 4.629 | 96.9 |
| 24 hours | 908794 | 5.958 | 3.116 | 5 |
| | 165574 | 5.219 | 4.065 | 15 |
| | 91339 | 4.961 | 4.624 | 80 |
| 48 hours | 1000083 | 6.000 | 3.095 | 57 |
| | 165168 | 5.218 | 4.089 | 14 |
| | 92123 | 4.964 | 4.649 | 29 |
| 1 week | 1055017 | 6.023 | 3.080 | 81 |
| | 167051 | 5.223 | 4.084 | 6 |
| | 93333 | 4.970 | 4.646 | 13 |
| 2 week | 1070333 | 6.030 | 3.087 | 93 |
| | 168418 | 5.226 | 4.085 | 2 |
| | 90472 | 4.957 | 4.685 | 5 |

Bold values indicate the monomer. Other values represent aggregates and dimers. Differences in the predicted MW and calculated MW are due, in part, to protein glycosylation.

TABLE 18 p40-IgG fusion. Predicted Molecular Weight (Da) - 215845.
Bold values indicate the monomer. Other values represent
aggregates and dimers. Differences in the predicted
MW and calculated MW are due, in part, to protein glycosylation.

| Time point | Calculated MW (Da) | interpolated Y value | Elution time (Vt) | % Area |
|---|---|---|---|---|
| 0 hours | 246412 | 5.392 | 3.787 | 100 |
| 24 hours | 803801 | 5.905 | 3.162 | 4 |
|  | 239288 | 5.379 | 3.779 | 96 |
| 48 hours | 912829 | 5.960 | 3.128 | 10 |
|  | 240573 | 5.381 | 3.793 | 90 |
| 1 week | 1114509 | 6.047 | 3.061 | 69 |
|  | 242653 | 5.385 | 3.791 | 31 |
| 2 week | 1179011 | 6.072 | 3.054 | 93 |
|  | 237524 | 5.376 | 3.815 | 7 |

TABLE 19 p35-MSA fusion. Predicted Molecular Weight (Da) - 92118.
Bold values indicate the monomer. Other values represent aggregates
and dimers. Differences in the predicted
MW and calculated MW are due, in part, to protein glycosylation.

| Time point | Calculated MW (Da) | interpolated Y value | Elution time (Vt) | % Area |
|---|---|---|---|---|
| 0 hours | 115158 | 5.061 | 4.438 | 100 |
| 24 hours | 113407 | 5.055 | 4.417 | 100 |
| 48 hours | 757199 | 5.879 | 3.199 | 9 |
|  | 253144 | 5.403 | 3.758 | 2 |
|  | 113751 | 5.056 | 4.443 | 90 |
| 1 week | 855333 | 5.932 | 3.156 | 21 |
|  | 257674 | 5.411 | 3.750 | 4 |
|  | 115312 | 5.062 | 4.437 | 75 |
| 2 week | 870909 | 5.940 | 3.161 | 51 |
|  | 116025 | 5.065 | 4.439 | 49 |

TABLE 20 p35-CH1-hinge-CH2—CH3 antibody fragment fusion.
Predicted Molecular Weight (Da) - 124339. Bold values indicate
the monomer. Other values represent aggregates and
dimers. Differences in the predicted MW and calculated MW
are due, in part, to protein glycosylation.

| Time point | Calculated MW (Da) | interpolated Y value | Elution time (Vt) | % Area |
|---|---|---|---|---|
| 0 hours | 150142 | 5.177 | 4.186 | 100 |
| 24 hours | 791345 | 5.898 | 3.168 | 11 |
|  | 145363 | 5.162 | 4.181 | 89 |
| 48 hours | 842195 | 5.925 | 3.158 | 22 |
|  | 145523 | 5.163 | 4.204 | 78 |
| 1 week | 935179 | 5.971 | 3.123 | 44 |
|  | 147343 | 5.168 | 4.198 | 56 |
| 2 week | 924568 | 5.966 | 3.139 | 62 |
|  | 143473 | 5.157 | 4.231 | 38 |

TABLE 21 scIL-12. Predicted Molecular Weight (Da) - 61001. Bold values
indicate the monomer. Other values represent aggregates and
dimers. Differences in the predicted MW
and calculated MW are due, in part, to protein glycosylation.

| Time point | Calculated MW (Da) | interpolated Y value | Elution time (Vt) | % Area |
|---|---|---|---|---|
| 0 hours | 104159 | 5.018 | 4.535 | 100 |
| 24 hours | 102149 | 5.009 | 4.518 | 100 |
| 48 hours | 103206 | 5.014 | 4.539 | 100 |
| 1 week | 1013855 | 6.006 | 3.094 | 3 |
|  | 105574 | 5.024 | 4.525 | 97 |
| 2 week | 1013733 | 6.006 | 3.106 | 4 |
|  | 102693 | 5.012 | 4.561 | 96 |

The p35-MSA fusion protein and p40-fab fusion protein were next tested for binding affinity to each other over time and at 37° C. Using the Octet platform described above, biotinylated p35-MSA was immobilized at a concentration range of 50 nM to 0.78 nM with p40-fab as the load at a concentration of 10-20 µg/mL. The binding affinity data at 0 hours, 4 hours, 24 hours, and 47 hours is reported below in Table 22. The results show that p35/p40 affinity remains high even after 47 hours at 37° C.

TABLE 22 p35-MSA/p40-fab Binding Affinity at 37° C.

| Time | KD (M) | KD Error | k on (1/Ms) | k on Error | k dis (1/s) | k dis Error | Full $R^2$ |
|---|---|---|---|---|---|---|---|
| 0 hr | 7.82E−09 | 4.78E−11 | 5.91E+04 | 2.15E+02 | 4.62E−04 | 2.27E−06 | 0.999 |
| 4 hr | 7.54E−09 | 5.34E−11 | 5.11E+04 | 1.94E+02 | 3.85E−04 | 2.30E−06 | 0.999 |
| 24 hr | 1.11E−08 | 6.70E−11 | 3.81E+04 | 1.32E+02 | 4.22E−04 | 2.10E−06 | 0.999 |
| 47 hr | 1.05E−08 | 8.68E−11 | 3.58E+04 | 1.60E+02 | 3.76E−04 | 2.61E−06 | 0.999 |

Example 4—Split IL-12 Activity

The therapeutic benefit of IL-12 is at least in part achieved when the p35 subunit and a p40 subunit are able to heterodimerize to form IL-12p70. To that end, the ability of each subunit with different fusion partners to heterodimerize was tested. The fusion protein combinations tested are recited below in Table 23.

TABLE 23

IL-12 Subunit Combinations

| Combination Number | Description |
|---|---|
| 1 | Human scIL-12 |
| 2 | p35-MSA + p40 without a fusion partner |
| 3 | p35-MSA + p40-Fab (anti-uPAR M37 Fab) |
| 4 | p35-MSA + p40-IgG (anti-uPAR M37 IgG) |
| 5 | p35-MSA + p40 with a E181R amino acid substitution |
| 6 | p35-CH1-HINGE-CH2—CH3 antibody fragment (anti-uPAR M37 KiH/p35 KiH pair) + p40 without a fusion partner |
| 7 | p35-CH1-HINGE-CH2—CH3 antibody fragment (anti-uPAR M37 KiH/p35 KiH pair) + p40 with a E181R amino acid substitution |

The above recited combinations were tested in a cell-based in vitro IL-12 activity assay. Briefly, frozen T cells (cultured with rhIL-2+CD3/CD28 for 9 days prior to assay start) were thawed, seeded at 300,000 cells/well and rested for 1 hour at 37° C. The IL-12 subunits were added to T cells at a 1:1 ratio (for a final starting concentration of each molecule at 250 nM). Phosphorylated Stat4 (pStat4) and IFN gamma were then detected. For the pStat4 detection assay, cells and IL-12 subunits were incubated for 45 minutes at 37° C. For the IFN gamma detection assay, cells and IL-12 subunits were incubated for 24 hours at 37° C. prior to collection of supernatant.

Figure 6A:
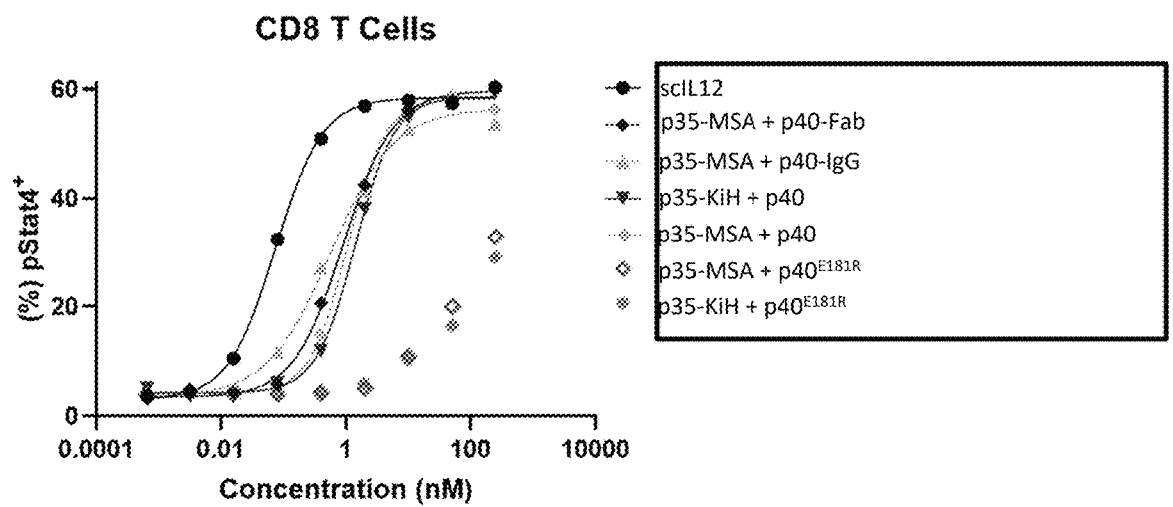
FIG. 6A-FIG. 6B depict cell-based in vitro IL-12 activity data as measured by % Stat4 phosphorylation in CD8+(FIG. 6A) and CD4+(FIG. 6B) T cells. IL-12 subunits were added to T cells at a 1:1 ratio over the recited concentrations.
Figure 6B:
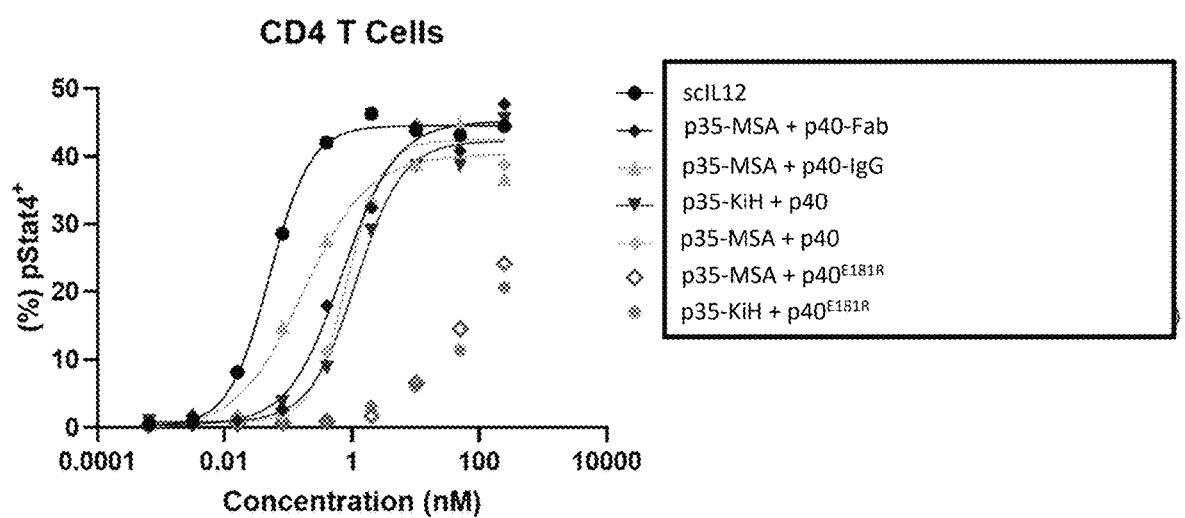

Each combination was tested for the ability to induce Stat4 phosphorylation in CD8+ (FIG. 6A) and CD4+ (FIG. 6B) T cells. Briefly, cells from each sample were fixed and incubated with an anti-pStat4 antibody labeled with the fluorophore phycoerythrin (PE). Fluorescence was then detected. The EC50 values and EC50 fold change relative to scIL-12 are recited below in Table 24 for the CD8+ T cells and Table 25 for the CD4+ T cells.

TABLE 24

EC50 values for % pStat4 Formation In CD8+ T cells

| | scIL-12 | p35-MSA + p40-Fab | p35-MSA + p40-IgG | p35 KIH + p40 | p35-MSA + p40 |
|---|---|---|---|---|---|
| EC50 (nM) | 0.0746 | 0.912 | 0.5714 | 1.419 | 1.060 |
| Fold Change | 1 | 12.23 | 7.66 | 19.02 | 14.21 |

TABLE 25

EC50 values for % pStat4 Formation In CD4+ T cells

| | scIL-12 | p35-MSA + p40-Fab | p35-MSA + p40-IgG | p35 KIH + p40 | p35-MSA + p40 |
|---|---|---|---|---|---|
| EC50 (nM) | .05115 | 0.7081 | 0.1726 | 1.159 | 0.8415 |
| Fold Change | 1 | 13.84 | 3.37 | 22.66 | 16.45 |

Figure 7:
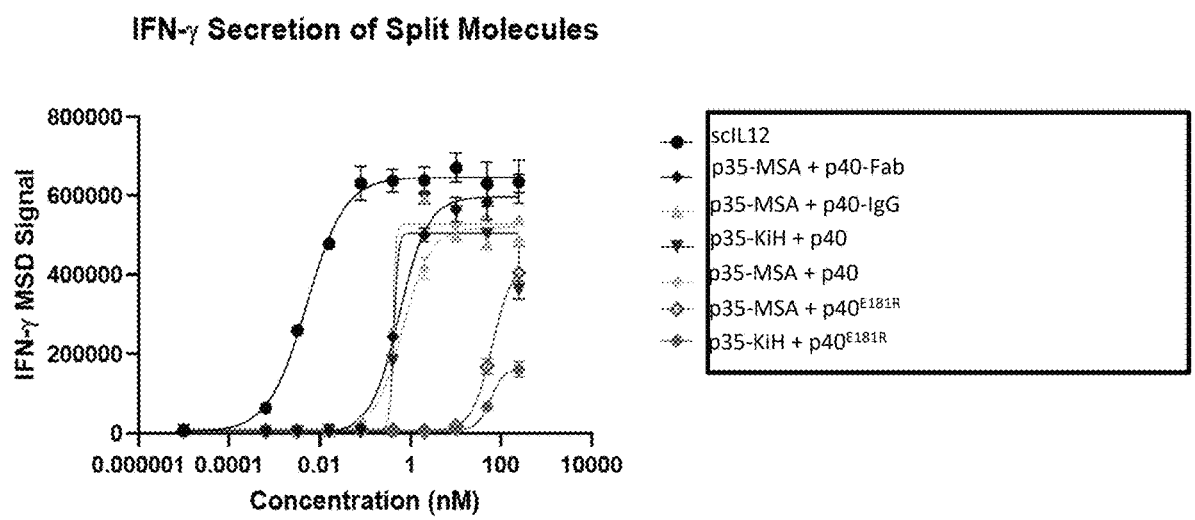
FIG. 7 depicts cell-based in vitro IL-12 activity data as measured by interferon (IFN) gamma secretion by T cells. IL-12 subunits were added to T cells at a 1:1 ratio over the recited concentrations.

Each combination was tested for the ability to induce IFN gamma production in cells as well (FIG. 7). The MSD T-Plex Cytokine Assay system was employed. The MSD assay is an ELISA-based assay, where the MSD plate is pre-coated with a capture antibody to IFN gamma. After incubating the sample on the plate, a labeled detection antibody that also binds IFN gamma was employed for chemiluminescent detection. The EC50 values and EC50 fold change relative to scIL-12 are recited below in Table 26.

TABLE 26

EC50 values for IFN gamma production

| | scIL-12 | p35-MSA + p40-Fab | p35-MSA + p40-IgG | p35 KIH + p40 | p35-MSA + p40 |
|---|---|---|---|---|---|
| EC50 (nM) | 0.00515 | 0.5591 | ~0.4029 | ~0.4274 | 0.6572 |
| Fold Change | 1 | 108.54 | 78.23 | 82.99 | 127.61 |

Example 5—Anti-uPAR/IL-12 Subunit Fusions

To enhance the therapeutic potency of IL-12, while reducing toxicity issues, the IL-12 subunits (p35 and p40) were linked to the parental anti-uPAR antibodies described above. The uPAR antibody-IL-12 subunit fusions can deliver the subunits to the target uPAR-expressing tissue or cell (e.g., tumor tissue or cell), thereby ensuring the potent IL-12 activity is only restored at the target site. To that end, the ability of each subunit with different uPAR antibody fusion partners to heterodimerize was tested. The fusion protein combinations tested and the binding affinities between p35 and p40 are recited below in Table 27. The binding affinity between the uPAR antibody fusions to uPAR (uPAR-his and uPAR-Fc) is also recited below.

TABLE 27

Binding Affinities For uPAR Antibody-IL-12 Subunit Fusions

| Combination | KD (M) | KD Error | kon (1/Ms) | kon Error | kdis (1/s) | kdis Error | Full $R^2$ |
|---|---|---|---|---|---|---|---|
| 4376 (p35-M1-scFv-KiH) + 4339 (M8-Fab-p40) | 6.98e−9 | 2.45e−10 | 1.95e+5 | 6.08e+3 | 1.36e−3 | 2.17e−5 | 0.934786 |
| 4379 (p35-M1-fab-KiH) + 4339 (M8-Fab-p40) | 6.84e−9 | 6.86e−11 | 8.56e+4 | 5.93e+2 | 5.85e−4 | 4.25e−6 | 0.995916 |
| 4376 (p35-M1-scFv-KiH) + 4336 (M8-IgG-p40) | 4.68e−9 | 8.43e−11 | 6.00e+4 | 4.58e+2 | 2.81e−4 | 4.58e−6 | 0.996298 |
| 4379 (p35-M1-fab-KiH) + 4336 (M8-IgG-p40)* | <1.0E−12 | | | | | | 0.998201 |
| 4398 (p35-M1-scFv2) + 4269 (p40) | 2.09e−8 | 2.21e−10 | 1.57e+4 | 1.22e+2 | 3.27e−4 | 2.34e−6 | 0.999902 |
| 4376 (p35-M1-scFv-KiH) uPAR-his | 1.49e−10 | 2.11e−12 | 2.66e+6 | 3.28e+4 | 3.96e−4 | 2.77e−6 | 0.98057 |
| 4379 (p35-M1-fab-uPAR-his) | 2.29e−10 | 5.79e−12 | 3.68e+6 | 8.89e+4 | 8.45e−4 | 6.18e−6 | 0.944841 |
| 4339 (M8-Fab-p40) uPAR-Fc | 1.72e−10 | 1.38e−12 | 1.69e+6 | 1.06e+4 | 2.91e−4 | 1.45e−6 | 0.994733 |
| 4398 (p35-M1-scFv2) + uPAR-Fc | 1.33e−10 | 1.94e−12 | 1.52e+6 | 1.48e+4 | 2.02e−4 | 2.19e−6 | 0.984586 |

*No affinity value obtained due to avidity of IgG molecule

Figure 5A:
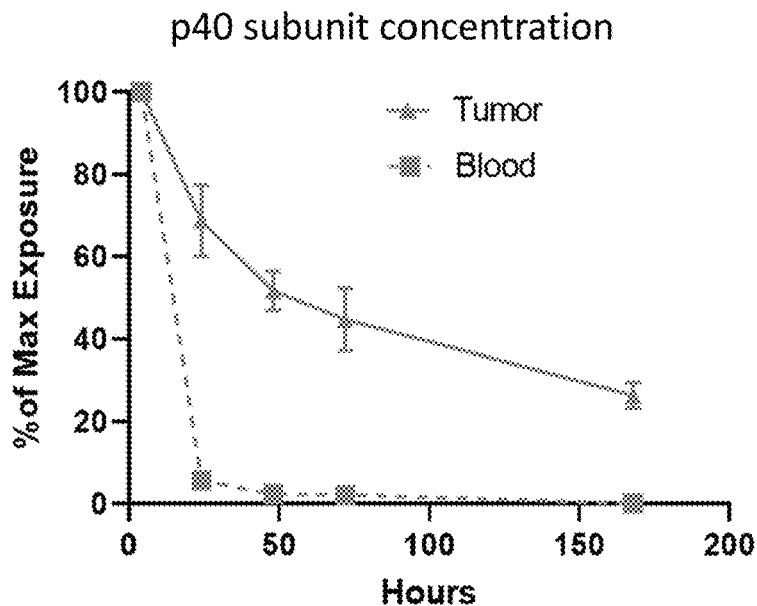
FIG. 5A-FIG. 5B depict tumor and serum pharmacokinetics from PET/CT imaging of radiolabeled tumor-targeted IL-12 subunits p40 (FIG. 5A) and p35 (FIG. 5B). Tumor-targeted subunits were measured in the tumor and blood of mice over time, and the % of maximum exposure was determined. The tumor targeted p40 was a fusion of the anti-uPAR antibody M37 in a Fab format with p40. The tumor targeted p35 was a fusion of the anti-uPAR antibody M37 in a KiH format with p35.
Figure 5B:
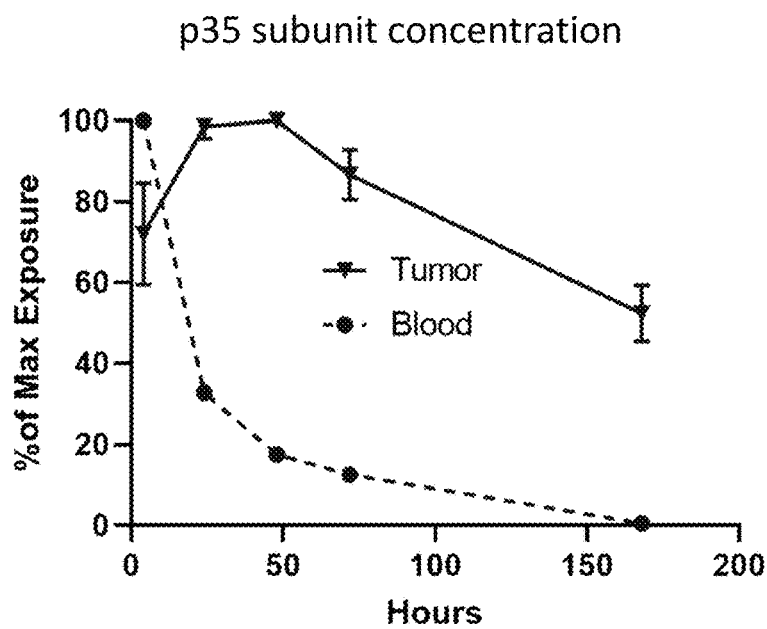

Select fusion proteins were next tested with in vivo mouse tumor models to show tumor and serum pharmacokinetics from PET/CT imaging of radiolabeled tumor-targeted IL-12 subunits p40 (FIG. 5A) and p35 (FIG. 5B). Tumor-targeted subunits were measured in the tumor and blood of mice over time, and the % of maximum exposure was determined. The tumor targeted p40 was a fusion of the anti-uPAR antibody M37 in a Fab format with p40. The tumor targeted p35 was a fusion of the anti-uPAR antibody M37 in a KiH format with p35. Briefly, CT26 tumor bearing BALB/c mice were administered the zirconium-89 ($^{89}$Zr)-labelled fusion proteins at molar mass of 15.5-16.9 nmol/kg (target: 16.4 nmol/kg) and a radioactive dose of 182 to 192 µCi in 200 injected intravenously (tail vein). The mice were subsequently imaged via PET/CT at 4 h, 24 h, 48 h, 72 h, and 168 h post injection. At each imaging time point, blood was collected for gamma counting.

Tumor clearance of targeted IL-12 subunits was slower than serum clearance, facilitating tumor-specific assembly.

Figure 8A:
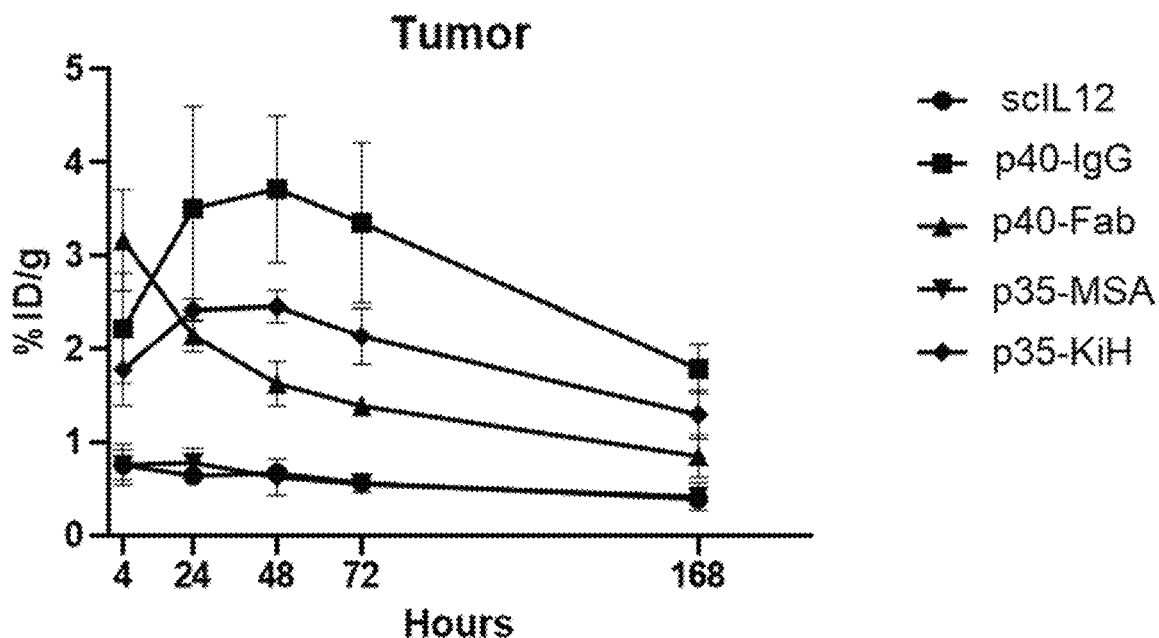
FIG. 8A-FIG. 8B depict IL-12 subunit accumulation in the tumor (FIG. 8A) and liver (FIG. 8B) of mouse tumor models. IL-12 subunit molecules were non-targeted scIL12, targeted Fab-p40, non-targeted p35-MSA, targeted IgG-p40, and targeted p35-KiH. "%ID/g" corresponds to percent of injected dose per gram of tissue.
Figure 8B:
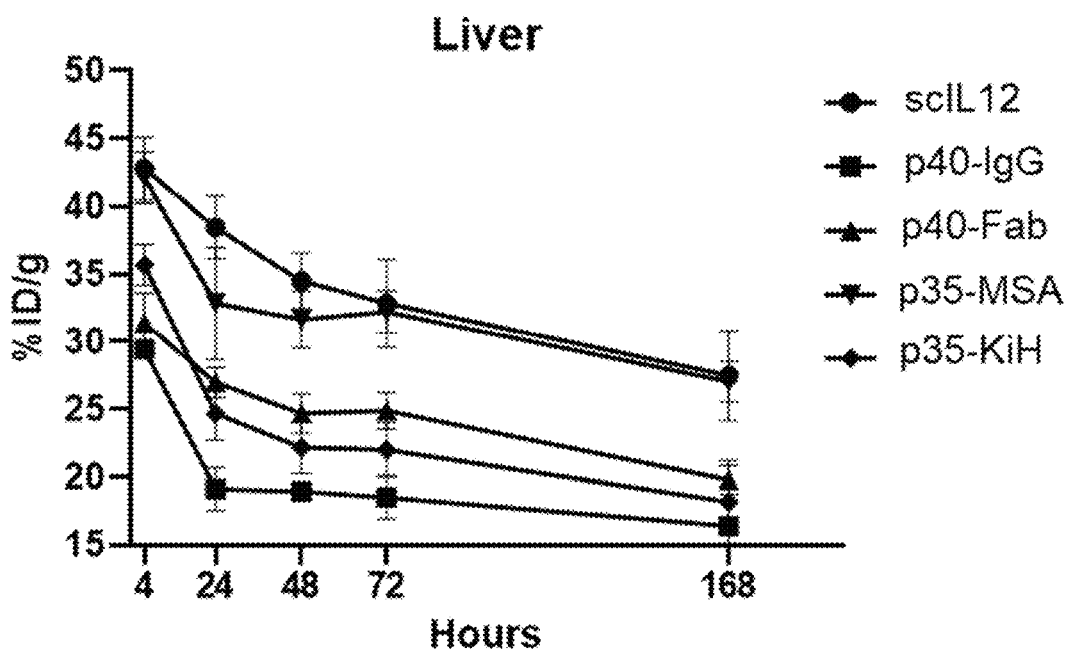

The above recited fusion proteins were also tested with in vivo mouse tumor models to show tumor and liver accumulation. Three anti-uPAR antibody fusion proteins were used as tumor targeted compounds and compared against non-targeted scIL-12 or a p35-MSA fusion protein. The three targeted fusion proteins were Fab-p40), IgG-p40, and p35-KiH. Each compound was radiolabeled to track tissue accumulation in the mouse. The assay was performed as above with $^{89}$Zr-labelled fusion proteins. As shown in FIG. 8A, targeted compounds accumulated in the tumor before beginning to dissipate over time. The untargeted compounds failed to accumulate. FIG. 8B shows liver accumulation over time, demonstrate progressive clearance of the compounds. The targeted compounds were cleared at a slower rate, indicating better retention compared to the untargeted compounds.

Figure 9:
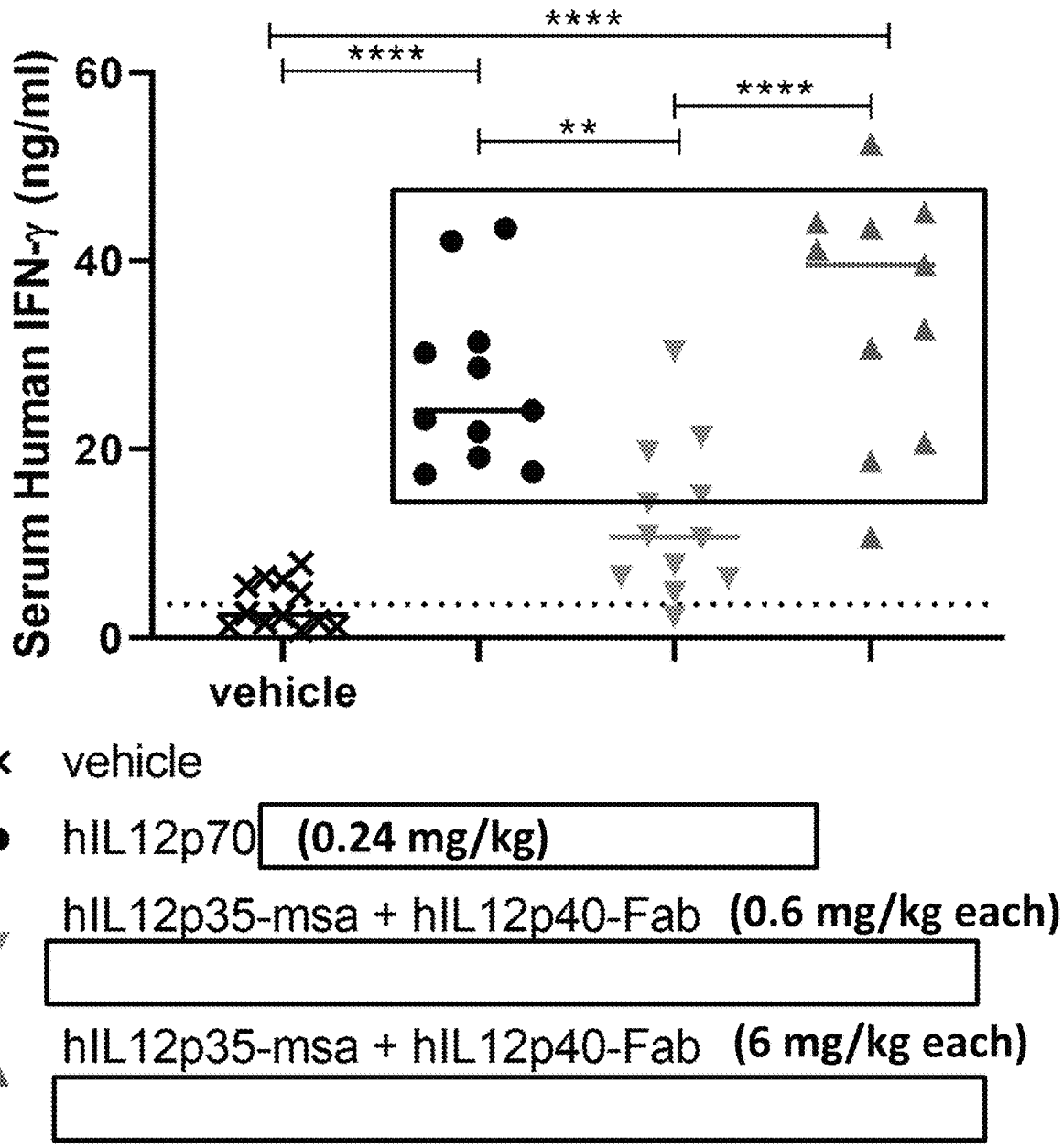
FIG. 9 depicts serum interferon (IFN) gamma concentration in mice receiving scIL-12 or the combination of p35-MSA and p40-Fab at two doses.

The fusions where then tested in a humanized mouse model to test for in vivo activity of sequentially administered human IL-12 subunits. Immune deficient NCG mice were humanized by injection of 1×10$^7$ human PBMCs. 14 days later mice were treated with PBS (vehicle), scIL-12, or two doses of split IL-12 molecules. For the split IL-12 molecules, p35-MSA was administered with p40-Fab. scIL-12 was administered at 0.24 mg/kg, while the split IL-12 molecules were administered at 0.6 mg/kg each (2.5× the dose of scIL-12) and 6 mg/kg each (25× the dose of scIL-12). The interval between injections was less than 5 minutes. Mice were then sampled for serum at various timepoints for serum pharmacokinetic and pharmacodynamic (serum IFN gamma concentration) analysis. The data shows that the split fusion molecules function in vivo. The data also shows a similar pharmacodynamic response between single chain and split molecules such that in the following experiments one can differentiate between the serum and tumor activity of these treatments (FIG. 9). Notably, a dose that is 2.5× that of the scIL-12 lead to less IFN gamma production, indicating reduced off-target toxicity issues with the split IL-12 fusions. This data further demonstrates the ability of the split IL-12 molecules in assemble in vivo.

Additional fusion proteins were tested, along with the potential of dual targeting (i.e., an antibody-p35 fusion and an antibody-p40 fusion, where each antibody binds different epitopes on the same target protein). The IL-12 subunits were attached to antibody variants M1 and M8 that bind to human uPAR. In this assay, the IL-12p70 complex is built by sequentially adding, followed by washing of the various components to human uPAR positive HEK cells. The uPAR-expressing HEK cells were then incubated with CD8+ T cells and pSTAT4 activity on said T cells was determined. The M37 antibody was used as an untargeted control, as this antibody binds to mouse uPAR and do not cross react with human uPAR. scIL-12 was used as an untargeted single compound. scIL12-M8 Fab fusion was used as a targeted single compound. M37-p40-Fab and M37-p35-KiH were used in combination as an untargeted negative control. M8-p40-Fab and M37-p35-KiH were used in combination as a single targeted combination (i.e., only one of the IL-12 subunits is targeted to uPAR). M8-p40-Fab and M1-p35-KiH-Fab were used in combination as a dual targeted combination (i.e., both of the IL-12 subunits, p35 and p40, are targeted to uPAR). Briefly, the assay was carried out with the following protocol:

1) 50,000 uPAR expressing HEK cells were seeded per well in 96-well U bottom, low attachment/binding plates (Corning Product #4520).
2) Plates were spun down, and cells were re-suspended with 100 μL of a titration of the first molecule.
3) Cells and the first molecule were incubated for 30 minutes at 4° C.
4) Cells were spun down and washed twice.
5) Cells were re-suspended with 100 μL of a titration of the second molecule.
6) Cells and molecule incubated for 30 minutes at 4° C.
7) Cells were spun down and washed three times.
8) Previously frozen human T cells (rested for 1 hour at 37° C.) were added to wells at 100,000 cells per well.
9) Plates were placed in the incubator for 1 hour (37° C.).
10) Plates were spun down, washed, and downstream staining protocols began.

After the T cell incubation step, pSTAT4 activity on said T cells was determined.

Figure 10:
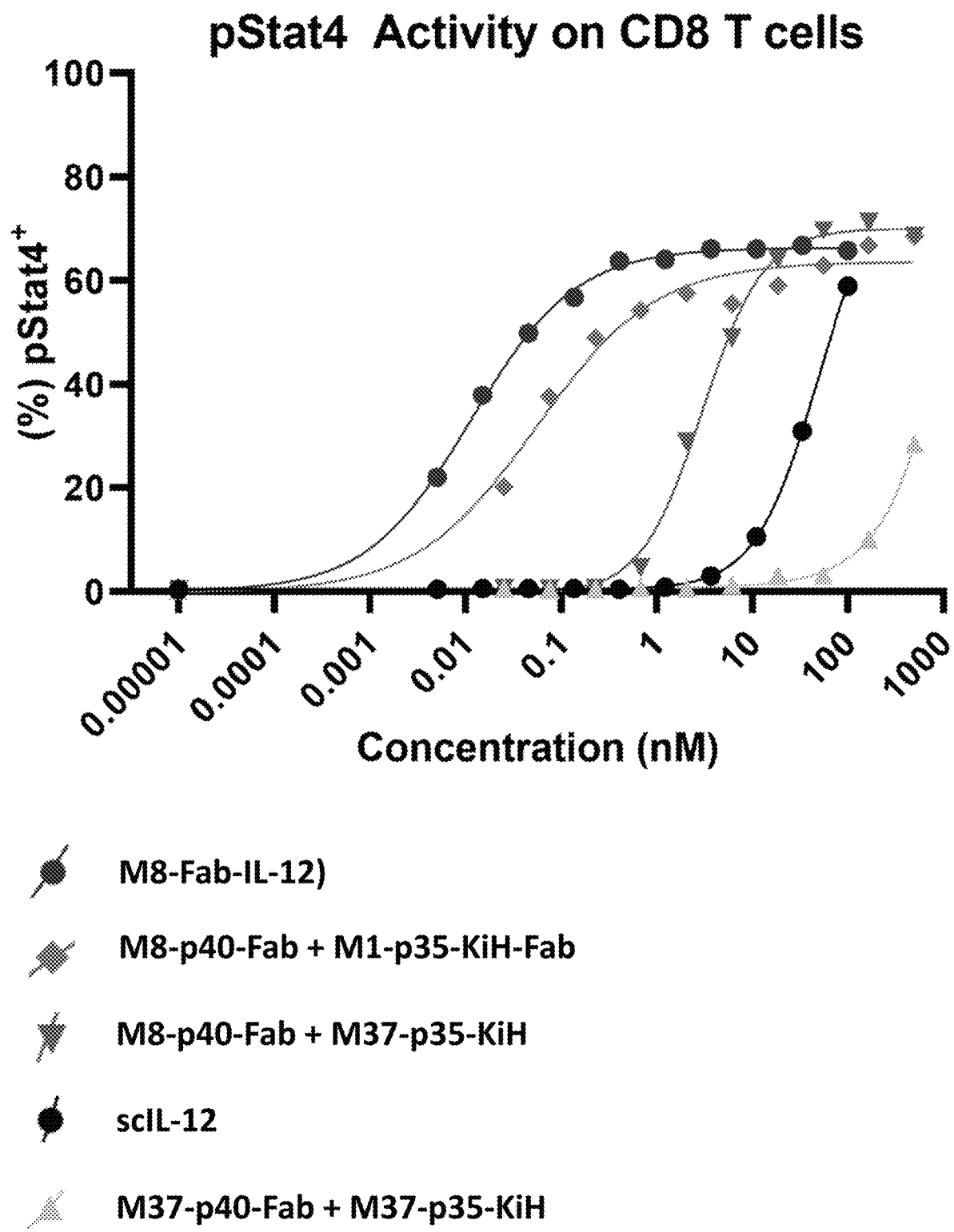
FIG. 10 depicts cell-based in vitro IL-12 activity data as measured by % Stat4 phosphorylation in CD8+T cells in a uPAR-expressing HEK cell/T cell co-culture. IL-12 subunits were added uPAR-expressing HEK cells at a 1:1 ratio over the recited concentrations before co-incubating with the CD8+T cells.

Untargeted subunits or untargeted scIL-12 showed reduced activity compared to targeted subunits. The single targeted combination showed enhanced activity relative to all untargeted approaches. Finally, the dual targeted subunits have improved activity compared to an individually targeted pair and recover most of the activity compared to targeted scIL-12, while enjoying reduced systemic toxicity (FIG. 10).

The above recited fusion proteins were generated with the parental anti-uPAR antibodies. Similar fusion proteins with the humanized anti-uPAR antibodies were also generated. The amino acid sequences for M1 fusions are recited below in Table 28. The amino acid sequences for M8 fusions are recited below in Table 29. The amino acid sequences for M43 fusions are recited below in Table 30.

TABLE 28

Humanized M1 antibody-IL-12 subunit fusion amino acid sequences

| Description | Sequence | Notes |
|---|---|---|
| hM1-IgG1(H1)-scIL12 | EVQLVQSGAEVKKPGATVKISCTASGFNIKDEYIN WVKQRPGKGLEWIGWIDPENGDTEYASKFQGRV TITADTSTDTAYLELSSLRSEDTAVYYCTGGNYV GWFPYWGQGTLVTVSSASTKGPSVFPLAPSSKST SGGTAALGCLVKDYFPEPVTVSWNSGALTSGVH TFPAVLQSSGLYSLSSVVTVPSSSLGTQTYICNVN HKPSNTKVDKKVEPKSCDKTHTCPPCPAPEAAGG PSVFLFPPKPKDTLMISRTPEVTCVVVDVSHEDPE VKFNWYVDGVEVHNAKTKPREEQYNSTYRVVS VLTVLHQDWLNGKEYKCKVSNKALPAPIEKTISK AKGQPREPQVYTLPPSRDELTKNQVSLTCLVKGF YPSDIAVEWESNGQPENNYKTTPPVLDSDGSFFL YSKLTVDKSRWQQGNVFSCSVMHEALHNHYTQ KSLSLSPGKGGGGSGGGGSGGGGSGGGGSIWELK KDVYVVELDWYPDAPGEMVVLTCDTPEEDGITW TLDQSSEVLGSGKTLTIQVKEFGDAGQYTCHKGG EVLSHSLLLLHKKEDGIWSTDILKDQKEPKNKTFL RCEAKNYSGRFTCWWLTTISTDLTFSVKSSRGSS DPQGVTCGAATLSAERVRGDNKEYEYSVECQED SACPAAEESLPIEVMVDAVHKLKYENYTSSFFIRD IIKPDPPKNLQLKPLKNSRQVEVSWEYPDTWSTPH SYFSLTFCVQVQGKSKREKKDRVFTDKTSATVIC RKNASISVRAQDRYYSSSWSEWASVPCSGGSGGG GSGGRNLPVATPDPGMFPCLHHSQNLLRAVSNM LQKARQTLEFYPCTSEEIDHEDITKDKTSTVEACL PLELTKNESCLNSRETSFITNGSCLASRKTSFMMA LCLSSIYEDLKMYQVEFKTMNAKLLMDPKRQIFL DQNMLAVIDELMQALNFNSETVPQKSSLEEPDFY KTKIKLCILLHAFRIRAVTIDRVMSYLNAS (SEQ ID NO: 165) | humanized M1, p40-p35 as scIL-12 |
| hM1-Fab(H1)-scIL12 | EVQLVQSGAEVKKPGATVKISCTASGFNIKDEYIN WVKQRPGKGLEWIGWIDPENGDTEYASKFQGRV TITADTSTDTAYLELSSLRSEDTAVYYCTGGNYV GWFPYWGQGTLVTVSSASTKGPSVFPLAPSSKST SGGTAALGCLVKDYFPEPVTVSWNSGALTSGVH TFPAVLQSSGLYSLSSVVTVPSSSLGTQTYICNVN HKPSNTKVDKKVEPKSCGGGGSGGGGSIWELKK | humanized M1, p40-p35, 6his avi |

TABLE 28-continued

Humanized M1 antibody-IL-12 subunit fusion amino acid sequences

| Description | Sequence | Notes |
|---|---|---|
| | DVYVVELDWYPDAPGEMVVLTCDTPEEDGITWT<br>LDQSSEVLGSGKTLTIQVKEFGDAGQYTCHKGGE<br>VLSHSLLLLHKKEDGIWSTDILKDQKEPKNKTFLR<br>CEAKNYSGRFTCWWLTTISTDLTFSVKSSRGSSDP<br>QGVTCGAATLSAERVRGDNKEYEYSVECQEDSA<br>CPAAEESLPIEVMVDAVHKLKYENYTSSFFIRDIIK<br>PDPPKNLQLKPLKNSRQVEVSWEYPDTWSTPHSY<br>FSLTFCVQVQGKSKREKKDRVFTDKTSATVICRK<br>NASISVRAQDRYYSSSWSEWASVPCSGGSGGGGS<br>GGRNLPVATPDPGMFPCLHHSQNLLRAVSNMLQ<br>KARQTLEFYPCTSEEIDHEDITKDKTSTVEACLPL<br>ELTKNESCLNSRETSFITNGSCLASRKTSFMMALC<br>LSSIYEDLKMYQVEFKTMNAKLLMDPKRQIFLDQ<br>NMLAVIDELMQALNFNSETVPQKSSLEEPDFYKT<br>KIKLCILLHAFRIRAVTIDRVMSYLNASGGSGGHH<br>HHHHGGSGLNDIFEAQKIEWHE (SEQ ID NO: 166) | |
| hM1-IgG1(H3)-<br>scIL12 | EVQLQQSGAEVKKPGATVKLSCTASGFNIKDEYI<br>NWVKQRPGQGLEWIGWIDPENGDTEYASKFQGR<br>ATITADTSTDTAYLELSSLRSEDTAVYYCTGGNY<br>VGWFPYWGQGTLVTVSSASTKGPSVFPLAPSSKS<br>TSGGTAALGCLVKDYFPEPVTVSWNSGALTSGV<br>HTFPAVLQSSGLYSLSSVVTVPSSSLGTQTYICNV<br>NHKPSNTKVDKKVEPKSCDKTHTCPPCPAPEAAG<br>GPSVFLFPPKPKDTLMISRTPEVTCVVVDVSHEDP<br>EVKFNWYVDGVEVHNAKTKPREEQYNSTYRVVS<br>VLTVLHQDWLNGKEYKCKVSNKALPAPIEKTISK<br>AKGQPREPQVYTLPPSRDELTKNQVSLTCLVKGF<br>YPSDIAVEWESNGQPENNYKTTPPVLDSDGSFFL<br>YSKLTVDKSRWQQGNVFSCSVMHEALHNHYTQ<br>KSLSLSPGKGGGGSGGGGSIWELKKDVYVVELD<br>WYPDAPGEMVVLTCDTPEEDGITWTLDQSSEVL<br>GSGKTLTIQVKEFGDAGQYTCHKGGEVLSHSLLL<br>LHKKEDGIWSTDILKDQKEPKNKTFLRCEAKNYS<br>GRFTCWWLTTISTDLTFSVKSSRGSSDPQGVTCG<br>AATLSAERVRGDNKEYEYSVECQEDSACPAAEES<br>LPIEVMVDAVHKLKYENYTSSFFIRDIIKPDPPKNL<br>QLKPLKNSRQVEVSWEYPDTWSTPHSYFSLTFCV<br>QVQGKSKREKKDRVFTDKTSATVICRKNASISVR<br>AQDRYYSSSWSEWASVPCSGGSGGGGSGGRNLP<br>VATPDPGMFPCLHHSQNLLRAVSNMLQKARQTL<br>EFYPCTSEEIDHEDITKDKTSTVEACLPLELTKNES<br>CLNSRETSFITNGSCLASRKTSFMMALCLSSIYED<br>LKMYQVEFKTMNAKLLMDPKRQIFLDQNMLAVI<br>DELMQALNFNSETVPQKSSLEEPDFYKTKIKLCIL<br>LHAFRIRAVTIDRVMSYLNAS (SEQ ID NO: 167) | humanized M1, p40-p35 |
| hM1-Fab(H3)-<br>scIL12 | EVQLQQSGAEVKKPGATVKLSCTASGFNIKDEYI<br>NWVKQRPGQGLEWIGWIDPENGDTEYASKFQGR<br>ATITADTSTDTAYLELSSLRSEDTAVYYCTGGNY<br>VGWFPYWGQGTLVTVSSASTKGPSVFPLAPSSKS<br>TSGGTAALGCLVKDYFPEPVTVSWNSGALTSGV<br>HTFPAVLQSSGLYSLSSVVTVPSSSLGTQTYICNV<br>NHKPSNTKVDKKVEPKSCGGGGSGGGGSIWELK<br>KDVYVVELDWYPDAPGEMVVLTCDTPEEDGITW<br>TLDQSSEVLGSGKTLTIQVKEFGDAGQYTCHKGG<br>EVLSHSLLLLHKKEDGIWSTDILKDQKEPKNKTFL<br>RCEAKNYSGRFTCWWLTTISTDLTFSVKSSRGSS<br>DPQGVTCGAATLSAERVRGDNKEYEYSVECQED<br>SACPAAEESLPIEVMVDAVHKLKYENYTSSFFIRD<br>IIKPDPPKNLQLKPLKNSRQVEVSWEYPDTWSTPH<br>SYFSLTFCVQVQGKSKREKKDRVFTDKTSATVIC<br>RKNASISVRAQDRYYSSSWSEWASVPCSGGSGGG<br>GSGGRNLPVATPDPGMFPCLHHSQNLLRAVSNM<br>LQKARQTLEFYPCTSEEIDHEDITKDKTSTVEACL<br>PLELTKNESCLNSRETSFITNGSCLASRKTSFMMA<br>LCLSSIYEDLKMYQVEFKTMNAKLLMDPKRQIFL<br>DQNMLAVIDELMQALNFNSETVPQKSSLEEPDFY<br>KTKIKLCILLHAFRIRAVTIDRVMSYLNASGGSGG<br>HHHHHHGGSGLNDIFEAQKIEWHE (SEQ ID NO: 168) | humanized M1, p40-p35, 6his avi |
| hM1-IgG1(H1)-<br>p40 | EVQLVQSGAEVKKPGATVKISCTASGFNIKDEYIN<br>WVKQRPGKGLEWIGWIDPENGDTEYASKFQGRV<br>TITADTSTDTAYLELSSLRSEDTAVYYCTGGNYV<br>GWFPYWGQGTLVTVSSASTKGPSVFPLAPSSKST | humanized M1, p40 C177S |

TABLE 28-continued

Humanized M1 antibody-IL-12 subunit fusion amino acid sequences

| Description | Sequence | Notes |
|---|---|---|
| | SGGTAALGCLVKDYFPEPVTVSWNSGALTSGVH TFPAVLQSSGLYSLSSVVTVPSSSLGTQTYICNVN HKPSNTKVDKKVEPKSCDKTHTCPPCPAPEAAGG PSVFLFPPKPKDTLMISRTPEVTCVVVDVSHEDPE VKFNWYVDGVEVHNAKTKPREEQYNSTYRVVS VLTVLHQDWLNGKEYKCKVSNKALPAPIEKTISK AKGQPREPQVYTLPPSRDELTKNQVSLTCLVKGF YPSDIAVEWESNGQPENNYKTTPPVLDSDGSFFL YSKLTVDKSRWQQGNVFSCSVMHEALHNHYTQ KSLSLSPGKGGGGSGGGGSIWELKKDVYVVELD WYPDAPGEMVVLTCDTPEEDGITWTLDQSSEVL GSGKTLTIQVKEFGDAGQYTCHKGGEVLSHSLLL LHKKEDGIWSTDILKDQKEPKNKTFLRCEAKNYS GRFTCWWLTTISTDLTFSVKSSRGSSDPQGVTCG AATLSAERVRGDNKEYEYSVECQEDSASPAAEES LPIEVMVDAVHKLKYENYTSSFFIRDIIKPDPPKNL QLKPLKNSRQVEVSWEYPDTWSTPHSYFSLTFSV QVQGKSKREKKDRVFTDKTSATVICRKNASISVR AQDRYYSSSWSEWASVPCS (SEQ ID NO: 169) | |
| hM1-Fab(H1)-p40 | EVQLVQSGAEVKKPGATVKISCTASGFNIKDEYIN WVKQRPGKGLEWIGWIDPENGDTEYASKFQGRV TITADTSTDTAYLELSSLRSEDTAVYYCTGGNYV GWFPYWGQGTLVTVSSASTKGPSVFPLAPSSKST SGGTAALGCLVKDYFPEPVTVSWNSGALTSGVH TFPAVLQSSGLYSLSSVVTVPSSSLGTQTYICNVN HKPSNTKVDKKVEPKSCGGGGSGGGGSIWELKK DVYVVELDWYPDAPGEMVVLTCDTPEEDGITWT LDQSSEVLGSGKTLTIQVKEFGDAGQYTCHKGGE VLSHSLLLLHKKEDGIWSTDILKDQKEPKNKTFLR CEAKNYSGRFTCWWLTTISTDLTFSVKSSRGSSDP QGVTCGAATLSAERVRGDNKEYEYSVECQEDSA SPAAEESLPIEVMVDAVHKLKYENYTSSFFIRDIIK PDPPKNLQLKPLKNSRQVEVSWEYPDTWSTPHSY FSLTFSVQVQGKSKREKKDRVFTDKTSATVICRK NASISVRAQDRYYSSSWSEWASVPCSGGSGLNDI FEAQKIEWHEGGSHHHHHH (SEQ ID NO: 170) | humanized M1, p40 C177S |
| hM1-ScFv(vH1-vL4)-p40 | EVQLVQSGAEVKKPGATVKISCTASGFNIKDEYIN WVKQRPGKGLEWIGWIDPENGDTEYASKFQGRV TITADTSTDTAYLELSSLRSEDTAVYYCTGGNYV GWFPYWGQGTLVTVSSGGGGSGGGGSGGGGSQI VLTQSPATLSASPGERVTMSCSASSSVSYMHWYQ QKPGTSPRRWLYDTSKLASGVPARFSGSGSGTDY TLTISSLEPEDFATYYCQQWSSNPPYTFGQGTKLE IKGGGGSGGGGSIWELKKDVYVVELDWYPDAPG EMVVLTCDTPEEDGITWTLDQSSEVLGSGKTLTIQ VKEFGDAGQYTCHKGGEVLSHSLLLLHKKEDGI WSTDILKDQKEPKNKTFLRCEAKNYSGRFTCWW LTTISTDLTFSVKSSRGSSDPQGVTCGAATLSAER VRGDNKEYEYSVECQEDSASPAAEESLPIEVMVD AVHKLKYENYTSSFFIRDIIKPDPPKNLQLKPLKNS RQVEVSWEYPDTWSTPHSYFSLTFSVQVQGKSKR EKKDRVFTDKTSATVICRKNASISVRAQDRYYSSS WSEWASVPCSGGSGLNDIFEAQKIEWHEGGSHH HHHH (SEQ ID NO: 171) | humanized M1, p40 C177S |
| hM1-ScFv(vL4-vH1)-p40 | QIVLTQSPATLSASPGERVTMSCSASSSVSYMHW YQQKPGTSPRRWLYDTSKLASGVPARFSGSGSGT DYTLTISSLEPEDFATYYCQQWSSNPPYTFGQGTK LEIKGGGGSGGGGSGGGGSEVQLVQSGAEVKKP GATVKISCTASGFNIKDEYINWVKQRPGKGLEWI GWIDPENGDTEYASKFQGRVTITADTSTDTAYLE LSSLRSEDTAVYYCTGGNYVGWFPYWGQGTLVT VSSGGGGSGGGGSIWELKKDVYVVELDWYPDAP GEMVVLTCDTPEEDGITWTLDQSSEVLGSGKTLTI QVKEFGDAGQYTCHKGGEVLSHSLLLLHKKEDGI WSTDILKDQKEPKNKTFLRCEAKNYSGRFTCWW LTTISTDLTFSVKSSRGSSDPQGVTCGAATLSAER VRGDNKEYEYSVECQEDSASPAAEESLPIEVMVD AVHKLKYENYTSSFFIRDIIKPDPPKNLQLKPLKNS RQVEVSWEYPDTWSTPHSYFSLTFSVQVQGKSKR EKKDRVFTDKTSATVICRKNASISVRAQDRYYSSS WSEWASVPCSGGSGLNDIFEAQKIEWHEGGSHH HHHH (SEQ ID NO: 172) | humanized M1, p40 C177S |

TABLE 28-continued

Humanized M1 antibody-IL-12 subunit fusion amino acid sequences

| Description | Sequence | Notes |
|---|---|---|
| hM1-Fab(H1)-Fc (knob) | EVQLVQSGAEVKKPGATVKISCTASGFNIKDEYIN<br>WVKQRPGKGLEWIGWIDPENGDTEYASKFQGRV<br>TITADTSTDTAYLELSSLRSEDTAVYYCTGGNYV<br>GWFPYWGQGTLVTVSSASTKGPSVFPLAPSSKST<br>SGGTAALGCLVKDYFPEPVTVSWNSGALTSGVH<br>TFPAVLQSSGLYSLSSVVTVPSSSLGTQTYICNVN<br>HKPSNTKVDKKVEPKSCGGGGSGGGGSEPKSSD<br>KTHTCPPCPAPEAAGGPSVFLFPPKPKDTLMISRT<br>PEVTCVVVDVSHEDPEVKFNWYVDGVEVHNAK<br>TKPREEQYNSTYRVVSVLTVLHQDWLNGKEYKC<br>KVSNKALGAPIEKTISKAKGQPREPQVCTLPPSRE<br>EMTKNQVSLWCLVKGFYPSDIAVEWESNGQPEN<br>NYKTTPPVLDSDGSFFLYSKLTVDKSRWQQGNVF<br>SCSVMHEALHNHYTQKSLSLSPGK (SEQ ID NO: 173) | humanized M1, Knob T366W, human IgG1, LALA-PG, effector function null |
| hM1-ScFv(vH1-vL4)-Fc(knob) | EVQLVQSGAEVKKPGATVKISCTASGFNIKDEYIN<br>WVKQRPGKGLEWIGWIDPENGDTEYASKFQGRV<br>TITADTSTDTAYLELSSLRSEDTAVYYCTGGNYV<br>GWFPYWGQGTLVTVSSGGGGSGGGGSGGGGSQI<br>VLTQSPATLSASPGERVTMSCSASSSVSYMHWYQ<br>QKPGTSPRRWLYDTSKLASGVPARFSGSGSGTDY<br>TLTISSLEPEDFATYYCQQWSSNPPYTFGQGTKLE<br>IKGGGGSGGGGSEPKSSDKTHTCPPCPAPEAAGG<br>PSVFLFPPKPKDTLMISRTPEVTCVVVDVSHEDPE<br>VKFNWYVDGVEVHNAKTKPREEQYNSTYRVVS<br>VLTVLHQDWLNGKEYKCKVSNKALGAPIEKTISK<br>AKGQPREPQVCTLPPSREEMTKNQVSLWCLVKG<br>FYPSDIAVEWESNGQPENNYKTTPPVLDSDGSFFL<br>YSKLTVDKSRWQQGNVFSCSVMHEALHNHYTQ<br>KSLSLSPGK (SEQ ID NO: 174) | humanized M1, Knob T366W, human IgG1, LALA-PG, effector function null |
| hM1-ScFv(vL4-vH1)-Fc(knob) | QIVLTQSPATLSASPGERVTMSCSASSSVSYMHW<br>YQQKPGTSPRRWLYDTSKLASGVPARFSGSGSGT<br>DYTLTISSLEPEDFATYYCQQWSSNPPYTFGQGTK<br>LEIKGGGGSGGGGSGGGGSEVQLVQSGAEVKKP<br>GATVKISCTASGFNIKDEYINWVKQRPGKGLEWI<br>GWIDPENGDTEYASKFQGRVTITADTSTDTAYLE<br>LSSLRSEDTAVYYCTGGNYVGWFPYWGQGTLVT<br>VSSGGGGSGGGGSEPKSSDKTHTCPPCPAPEAAG<br>GPSVFLFPPKPKDTLMISRTPEVTCVVVDVSHEDP<br>EVKFNWYVDGVEVHNAKTKPREEQYNSTYRVVS<br>VLTVLHQDWLNGKEYKCKVSNKALGAPIEKTISK<br>AKGQPREPQVCTLPPSREEMTKNQVSLWCLVKG<br>FYPSDIAVEWESNGQPENNYKTTPPVLDSDGSFFL<br>YSKLTVDKSRWQQGNVFSCSVMHEALHNHYTQ<br>KSLSLSPGK (SEQ ID NO: 175) | humanized M1, Knob T366W, human IgG1, LALA-PG, effector function null |
| p35-hM1-ScFv(vH1-vL4)2 | RNLPVATPDPGMFPCLHHSQNLLRAVDNMLQKA<br>RQTLEFYPCTSEEIDHEDITKDKTSTVEACLPLELT<br>KNESKLNSRETSFITNGSCLASRKTSFMMALCLSS<br>IYEDLKMYQVEFKTMNAKLLMDPKRQIFLDQNM<br>LAVIDELMQALNFNSETVPQKSSLEEPDFYKTKIK<br>LCILLHAFRIRAVTINRVMSYLNASGGGGSGGGG<br>SEVQLVQSGAEVKKPGATVKISCTASGFNIKDEYI<br>NWVKQRPGKGLEWIGWIDPENGDTEYASKFQGR<br>VTITADTSTDTAYLELSSLRSEDTAVYYCTGGNY<br>VGWFPYWGQGTLVTVSSGGGGSGGGGSGGGGS<br>QIVLTQSPATLSASPGERVTMSCSASSSVSYMHW<br>YQQKPGTSPRRWLYDTSKLASGVPARFSGSGSGT<br>DYTLTISSLEPEDFATYYCQQWSSNPPYTFGQGTK<br>LEIKGGSGGGGSGGGSGGGGSGGGGSGGSGGE<br>VQLVQSGAEVKKPGATVKISCTASGFNIKDEYIN<br>WVKQRPGKGLEWIGWIDPENGDTEYASKFQGRV<br>TITADTSTDTAYLELSSLRSEDTAVYYCTGGNYV<br>GWFPYWGQGTLVTVSSGGGGSGGGGSGGGGSQI<br>VLTQSPATLSASPGERVTMSCSASSSVSYMHWYQ<br>QKPGTSPRRWLYDTSKLASGVPARFSGSGSGTDY<br>TLTISSLEPEDFATYYCQQWSSNPPYTFGQGTKLE<br>IKGGSGLNDIFEAQKIEWHEGGSHHHHHH (SEQ ID NO: 176) | humanized M1, p35 S27D, C74K, D188N |
| p35-hM1-ScFv(vL4-vH1)2 | RNLPVATPDPGMFPCLHHSQNLLRAVDNMLQKA<br>RQTLEFYPCTSEEIDHEDITKDKTSTVEACLPLELT<br>KNESKLNSRETSFITNGSCLASRKTSFMMALCLSS<br>IYEDLKMYQVEFKTMNAKLLMDPKRQIFLDQNM | humanized M1, p35 S27D, C74K, D188N |

TABLE 28-continued

Humanized M1 antibody-IL-12 subunit fusion amino acid sequences

| Description | Sequence | Notes |
|---|---|---|
| | LAVIDELMQALNFNSETVPQKSSLEEPDFYKTKIK<br>LCILLHAFRIRAVTINRVMSYLNASGGGGSGGGG<br>SQIVLTQSPATLSASPGERVTMSCSASSSVSYMH<br>WYQQKPGTSPRRWLYDTSKLASGVPARFSGSGS<br>GTDYTLTISSLEPEDFATYYCQQWSSNPPYTFGQG<br>TKLEIKGGGGSGGGGSGGGGSEVQLVQSGAEVK<br>KPGATVKISCTASGFNIKDEYINWVKQRPGKGLE<br>WIGWIDPENGDTEYASKFQGRVTITADTSTDTAY<br>LELSSLRSEDTAVYYCTGGNYVGWFPYWGQGTL<br>VTVSSGGSGGGGSGGGSGGGGSGGGGSGGGSGG<br>QIVLTQSPATLSASPGERVTMSCSASSSVSYMHW<br>YQQKPGTSPRRWLYDTSKLASGVPARFSGSGSGT<br>DYTLTISSLEPEDFATYYCQQWSSNPPYTFGQGTK<br>LEIKGGGGSGGGGSGGGGSEVQLVQSGAEVKKP<br>GATVKISCTASGFNIKDEYINWVKQRPGKGLEWI<br>GWIDPENGDTEYASKFQGRVTITADTSTDTAYLE<br>LSSLRSEDTAVYYCTGGNYVGWFPYWGQGTLVT<br>VSSGGSGLNDIFEAQKIEWHEGGSHHHHHH (SEQ<br>ID NO: 177) | |
| hM1-IgG1(H3)-<br>p40 | EVQLQQSGAEVKKPGATVKLSCTASGFNIKDEYI<br>NWVKQRPGQGLEWIGWIDPENGDTEYASKFQGR<br>ATITADTSTDTAYLELSSLRSEDTAVYYCTGGNY<br>VGWFPYWGQGTLVTVSSASTKGPSVFPLAPSSKS<br>TSGGTAALGCLVKDYFPEPVTVSWNSGALTSGV<br>HTFPAVLQSSGLYSLSSVVTVPSSSLGTQTYICNV<br>NHKPSNTKVDKKVEPKSCDKTHTCPPCPAPEAAG<br>GPSVFLFPPKPKDTLMISRTPEVTCVVVDVSHEDP<br>EVKFNWYVDGVEVHNAKTKPREEQYNSTYRVVS<br>VLTVLHQDWLNGKEYKCKVSNKALPAPIEKTISK<br>AKGQPREPQVYTLPPSRDELTKNQVSLTCLVKGF<br>YPSDIAVEWESNGQPENNYKTTPPVLDSDGSFFL<br>YSKLTVDKSRWQQGNVFSCSVMHEALHNHYTQ<br>KSLSLSPGKGGGGSGGGGSIWELKKDVYVVELD<br>WYPDAPGEMVVLTCDTPEEDGITWTLDQSSEVL<br>GSGKTLTIQVKEFGDAGQYTCHKGGEVLSHSLLL<br>LHKKEDGIWSTDILKDQKEPKNKTFLRCEAKNYS<br>GRFTCWWLTTISTDLTFSVKSSRGSSDPQGVTCG<br>AATLSAERVRGDNKEYEYSVECQEDSASPAAEES<br>LPIEVMVDAVHKLKYENYTSSFFIRDIIKPDPPKNL<br>QLKPLKNSRQVEVSWEYPDTWSTPHSYFSLTFSV<br>QVQGKSKREKKDRVFTDKTSATVICRKNASISVR<br>AQDRYYSSSWSEWASVPCS (SEQ ID NO: 178) | humanized M1, p40<br>C177S |
| hM1-Fab(H3)-<br>p40 | EVQLQQSGAEVKKPGATVKLSCTASGFNIKDEYI<br>NWVKQRPGQGLEWIGWIDPENGDTEYASKFQGR<br>ATITADTSTDTAYLELSSLRSEDTAVYYCTGGNY<br>VGWFPYWGQGTLVTVSSASTKGPSVFPLAPSSKS<br>TSGGTAALGCLVKDYFPEPVTVSWNSGALTSGV<br>HTFPAVLQSSGLYSLSSVVTVPSSSLGTQTYICNV<br>NHKPSNTKVDKKVEPKSCGGGGSGGGGSIWELK<br>KDVYVVELDWYPDAPGEMVVLTCDTPEEDGITW<br>TLDQSSEVLGSGKTLTIQVKEFGDAGQYTCHKGG<br>EVLSHSLLLLHKKEDGIWSTDILKDQKEPKNKTFL<br>RCEAKNYSGRFTCWWLTTISTDLTFSVKSSRGSS<br>DPQGVTCGAATLSAERVRGDNKEYEYSVECQED<br>SASPAAEESLPIEVMVDAVHKLKYENYTSSFFIRD<br>IIKPDPPKNLQLKPLKNSRQVEVSWEYPDTWSTPH<br>SYFSLTFSVQVQGKSKREKKDRVFTDKTSATVIC<br>RKNASISVRAQDRYYSSSWSEWASVPCSGGSGLN<br>DIFEAQKIEWHEGGSHHHHHH (SEQ ID NO: 265) | humanized M1, p40<br>C177S |
| hM1-ScFv(vH3-<br>vL1)-p40 | EVQLQQSGAEVKKPGATVKLSCTASGFNIKDEYI<br>NWVKQRPGQGLEWIGWIDPENGDTEYASKFQGR<br>ATITADTSTDTAYLELSSLRSEDTAVYYCTGGNY<br>VGWFPYWGQGTLVTVSSGGGGSGGGGSGGGGS<br>EIVLTQSPATLSLSPGERATLSCSASSSVSYMHWY<br>QQKPGTSPRRWIYDTSKLASGVPARFSGSGSGTD<br>FTLTISSLEPEDFAVYYCQQWSSNPPYTFGQGTKL<br>EIKGGGGSGGGGSIWELKKDVYVVELDWYPDAP<br>GEMVVLTCDTPEEDGITWTLDQSSEVLGSGKTLTI<br>QVKEFGDAGQYTCHKGGEVLSHSLLLLHKKEDGI<br>WSTDILKDQKEPKNKTFLRCEAKNYSGRFTCWW<br>LTTISTDLTFSVKSSRGSSDPQGVTCGAATLSAER<br>VRGDNKEYEYSVECQEDSASPAAEESLPIEVMVD<br>AVHKLKYENYTSSFFIRDIIKPDPPKNLQLKPLKNS | humanized M1, p40<br>C177S |

TABLE 28-continued

Humanized M1 antibody-IL-12 subunit fusion amino acid sequences

| Description | Sequence | Notes |
|---|---|---|
| | RQVEVSWEYPDTWSTPHSYFSLTFSVQVQGKSKR EKKDRVFTDKTSATVICRKNASISVRAQDRYYSSS WSEWASVPCSGGSGLNDIFEAQKIEWHEGGSHH HHHH (SEQ ID NO: 180) | |
| hM1-ScFv(vL1-vH3)-p40 | EIVLTQSPATLSLSPGERATLSCSASSSVSYMHWY QQKPGTSPRRWIYDTSKLASGVPARFSGSGSGTD FTLTISSLEPEDFAVYYCQQWSSNPPYTFGQGTKL EIKGGGGSGGGGSGGGGSEVQLQQSGAEVKKPG ATVKLSCTASGFNIKDEYINWVKQRPGQGLEWIG WIDPENGDTEYASKFQGRATITADTSTDTAYLELS SLRSEDTAVYYCTGGNYVGWFPYWGQGTLVTVS SGGGGSGGGGSIWELKKDVYVVELDWYPDAPGE MVVLTCDTPEEDGITWTLDQSSEVLGSGKTLTIQ VKEFGDAGQYTCHKGGEVLSHSLLLLHKKEDGI WSTDILKDQKEPKNKTFLRCEAKNYSGRFTCWW LTTISTDLTFSVKSSRGSSDPQGVTCGAATLSAER VRGDNKEYEYSVECQEDSASPAAEESLPIEVMVD AVHKLKYENYTSSFFIRDIIKPDPPKNLQLKPLKNS RQVEVSWEYPDTWSTPHSYFSLTFSVQVQGKSKR EKKDRVFTDKTSATVICRKNASISVRAQDRYYSSS WSEWASVPCSGGSGLNDIFEAQKIEWHEGGSHH HHHH (SEQ ID NO: 181) | humanized M1, p40 C177S |
| hM1-Fab(H3)-Fc (knob) | EVQLQQSGAEVKKPGATVKLSCTASGFNIKDEYI NWVKQRPGQGLEWIGWIDPENGDTEYASKFQGR ATITADTSTDTAYLELSSLRSEDTAVYYCTGGNY VGWFPYWGQGTLVTVSSASTKGPSVFPLAPSSKS TSGGTAALGCLVKDYFPEPVTVSWNSGALTSGV HTFPAVLQSSGLYSLSSVVTVPSSSLGTQTYICNV NHKPSNTKVDKKVEPKSCGGGGSGGGGSEPKSS DKTHTCPPCPAPEAAGGPSVFLFPPKPKDTLMISR TPEVTCVVVDVSHEDPEVKFNWYVDGVEVHNA KTKPREEQYNSTYRVVSVLTVLHQDWLNGKEYK CKVSNKALGAPIEKTISKAKGQPREPQVCTLPPSR EEMTKNQVSLWCLVKGFYPSDIAVEWESNGQPE NNYKTTPPVLDSDGSFFLYSKLTVDKSRWQQGN VFSCSVMHEALHNHYTQKSLSLSPGK (SEQ ID NO: 182) | humanized M1, Knob T366W, human IgG1, LALA-PG, effector function null |
| hM1-ScFv(vL1-vH3)-Fc(knob) | EIVLTQSPATLSLSPGERATLSCSASSSVSYMHWY QQKPGTSPRRWIYDTSKLASGVPARFSGSGSGTD FTLTISSLEPEDFAVYYCQQWSSNPPYTFGQGTKL EIKGGGGSGGGGSGGGGSEVQLQQSGAEVKKPG ATVKLSCTASGFNIKDEYINWVKQRPGQGLEWIG WIDPENGDTEYASKFQGRATITADTSTDTAYLELS SLRSEDTAVYYCTGGNYVGWFPYWGQGTLVTVS SGGGGSGGGGSEPKSSDKTHTCPPCPAPEAAGGP SVFLFPPKPKDTLMISRTPEVTCVVVDVSHEDPEV KFNWYVDGVEVHNAKTKPREEQYNSTYRVVSVL TVLHQDWLNGKEYKCKVSNKALGAPIEKTISKA KGQPREPQVCTLPPSREEMTKNQVSLWCLVKGF YPSDIAVEWESNGQPENNYKTTPPVLDSDGSFFL YSKLTVDKSRWQQGNVFSCSVMHEALHNHYTQ KSLSLSPGK (SEQ ID NO: 183) | humanized M1, Knob T366W, human IgG1, LALA-PG, effector function null |
| p35-hM1-ScFv(vL1-vH3)2 | RNLPVATPDPGMFPCLHHSQNLLRAVDNMLQKA RQTLEFYPCTSEEIDHEDITKDKTSTVEACLPLELT KNESKLNSRETSFITNGSCLASRKTSFMMALCLSS IYEDLKMYQVEFKTMNAKLLMDPKRQIFLDQNM LAVIDELMQALNFNSETVPQKSSLEEPDFYKTKIK LCILLHAFRIRAVTINRVMSYLNASGGGGSGGGG SEIVLTQSPATLSLSPGERATLSCSASSSVSYMHW YQQKPGTSPRRWIYDTSKLASGVPARFSGSGSGT DFTLTISSLEPEDFAVYYCQQWSSNPPYTFGQGTK LEIKGGGGSGGGGSGGGGSEVQLQQSGAEVKKP GATVKLSCTASGFNIKDEYINWVKQRPGQGLEWI GWIDPENGDTEYASKFQGRATITADTSTDTAYLE LSSLRSEDTAVYYCTGGNYVGWFPYWGQGTLVT VSSGGGGSGGGGSGGGGSGGGGSGGGGSGGEI VLTQSPATLSLSPGERATLSCSASSSVSYMHWYQ QKPGTSPRRWIYDTSKLASGVPARFSGSGSGTDFT LTISSLEPEDFAVYYCQQWSSNPPYTFGQGTKLEI KGGGGSGGGGSGGGGSEVQLQQSGAEVKKPGAT VKLSCTASGFNIKDEYINWVKQRPGQGLEWIGWI DPENGDTEYASKFQGRATITADTSTDTAYLELSSL | humanized M1, p35 S27D, C74K, D188N |

TABLE 28-continued

Humanized M1 antibody-IL-12 subunit fusion amino acid sequences

| Description | Sequence | Notes |
|---|---|---|
| | RSEDTAVYYCTGGNYVGWFPYWGQGTLVTVSS GGSGLNDIFEAQKIEWHEGGSHHHHHH (SEQ ID NO: 184) | |
| hM1-ScFv(vH3-vL4)-p40 | EVQLQQSGAEVKKPGATVKLSCTASGFNIKDEYI NWVKQRPGQGLEWIGWIDPENGDTEYASKFQGR ATITADTSTDTAYLELSSLRSEDTAVYYCTGGNY VGWFPYWGQGTLVTVSSGGGGSGGGGSGGGGS QIVLTQSPATLSASPGERVTMSCSASSSVSYMHW YQQKPGTSPRRWLYDTSKLASGVPARFSGSGSGT DYTLTISSLEPEDFATYYCQQWSSNPPYTFGQGTK LEIKGGGGSGGGGSIWELKKDVYVVELDWYPDA PGEMVVLTCDTPEEDGITWTLDQSSEVLGSGKTL TIQVKEFGDAGQYTCHKGGEVLSHSLLLLHKKED GIWSTDILKDQKEPKNKTFLRCEAKNYSGRFTCW WLTTISTDLTFSVKSSRGSSDPQGVTCGAATLSAE RVRGDNKEYEYSVECQEDSASPAAEESLPIEVMV DAVHKLKYENYTSSFFIRDIIKPDPPKNLQKPLK NSRQVEVSWEYPDTWSTPHSYFSLTFSVQVQGKS KREKKDRVFTDKTSATVICRKNASISVRAQDRYY SSSWSEWASVPCSGGSGLNDIFEAQKIEWHEGGS HHHHHH (SEQ ID NO: 185) | humanized M1, p40 C177S |
| hM1-ScFv(vL4-vH3)-p40 | QIVLTQSPATLSASPGERVTMSCSASSSVSYMHW YQQKPGTSPRRWLYDTSKLASGVPARFSGSGSGT DYTLTISSLEPEDFATYYCQQWSSNPPYTFGQGTK LEIKGGGGSGGGGSGGGGSEVQLQQSGAEVKKP GATVKLSCTASGFNIKDEYINWVKQRPGQGLEWI GWIDPENGDTEYASKFQGRATITADTSTDTAYLE LSSLRSEDTAVYYCTGGNYVGWFPYWGQGTLVT VSSGGGGSGGGGSIWELKKDVYVVELDWYPDAP GEMVVLTCDTPEEDGITWTLDQSSEVLGSGKTLTI QVKEFGDAGQYTCHKGGEVLSHSLLLLHKKEDGI WSTDILKDQKEPKNKTFLRCEAKNYSGRFTCWW LTTISTDLTFSVKSSRGSSDPQGVTCGAATLSAER VRGDNKEYEYSVECQEDSASPAAEESLPIEVMVD AVHKLKYENYTSSFFIRDIIKPDPPKNLQKPLKNS RQVEVSWEYPDTWSTPHSYFSLTFSVQVQGKSKR EKKDRVFTDKTSATVICRKNASISVRAQDRYYSSS WSEWASVPCSGGSGLNDIFEAQKIEWHEGGSHH HHHH (SEQ ID NO: 186) | humanized M1, p40 C177S |
| hM1-ScFv(vH3-vL4)-Fc(knob) | EVQLQQSGAEVKKPGATVKLSCTASGFNIKDEYI NWVKQRPGQGLEWIGWIDPENGDTEYASKFQGR ATITADTSTDTAYLELSSLRSEDTAVYYCTGGNY VGWFPYWGQGTLVTVSSGGGGSGGGGSGGGGS QIVLTQSPATLSASPGERVTMSCSASSSVSYMHW YQQKPGTSPRRWLYDTSKLASGVPARFSGSGSGT DYTLTISSLEPEDFATYYCQQWSSNPPYTFGQGTK LEIKGGGGSGGGGSEPKSSDKTHTCPPCPAPEAAG GPSVFLFPPKPKDTLMISRTPEVTCVVVDVSHEDP EVKFNWYVDGVEVHNAKTKPREEQYNSTYRVVS VLTVLHQDWLNGKEYKCKVSNKALGAPIEKTISK AKGQPREPQVCTLPPSREEMTKNQVSLWCLVKG FYPSDIAVEWESNGQPENNYKTTPPVLDSDGSFFL YSKLTVDKSRWQQGNVFSCSVMHEALHNHYTQ KSLSLSPGK (SEQ ID NO: 187) | humanized M1, Knob T366W, human IgG1, LALA-PG, effector function null |
| hM1-ScFv(vL4-vH3)-Fc(knob) | QIVLTQSPATLSASPGERVTMSCSASSSVSYMHW YQQKPGTSPRRWLYDTSKLASGVPARFSGSGSGT DYTLTISSLEPEDFATYYCQQWSSNPPYTFGQGTK LEIKGGGGSGGGGSGGGGSEVQLQQSGAEVKKP GATVKLSCTASGFNIKDEYINWVKQRPGQGLEWI GWIDPENGDTEYASKFQGRATITADTSTDTAYLE LSSLRSEDTAVYYCTGGNYVGWFPYWGQGTLVT VSSGGGGSGGGGSEPKSSDKTHTCPPCPAPEAAG GPSVFLFPPKPKDTLMISRTPEVTCVVVDVSHEDP EVKFNWYVDGVEVHNAKTKPREEQYNSTYRVVS VLTVLHQDWLNGKEYKCKVSNKALGAPIEKTISK AKGQPREPQVCTLPPSREEMTKNQVSLWCLVKG FYPSDIAVEWESNGQPENNYKTTPPVLDSDGSFFL YSKLTVDKSRWQQGNVFSCSVMHEALHNHYTQ KSLSLSPGK (SEQ ID NO: 188) | humanized M1, Knob T366W, human IgG1, LALA-PG, effector function null |

TABLE 28-continued

| Humanized M1 antibody-IL-12 subunit fusion amino acid sequences | | |
|---|---|---|
| Description | Sequence | Notes |
| p35-hM1-ScFv(vH3-vL4)2 | RNLPVATPDPGMFPCLHHSQNLLRAVDNMLQKA RQTLEFYPCTSEEIDHEDITKDKTSTVEACLPLELT KNESKLNSRETSFITNGSCLASRKTSFMMALCLSS IYEDLKMYQVEFKTMNAKLLMDPKRQIFLDQNM LAVIDELMQALNFNSETVPQKSSLEEPDFYKTKIK LCILLHAFRIRAVTINRVMSYLNASGGGGSGGGG SEVQLQQSGAEVKKPGATVKLSCTASGFNIKDEY INWVKQRPGQGLEWIGWIDPENGDTEYASKFQG RATITADTSTDTAYLELSSLRSEDTAVYYCTGGN YVGWFPYWGQGTLVTVSSGGGGSGGGGSGGGG SQIVLTQSPATLSASPGERVTMSCSASSSVSYMH WYQQKPGTSPRRWLYDTSKLASGVPARFSGSGS GTDYTLTISSLEPEDFATYYCQQWSSNPPYTFGQG TKLEIKGGSGGGGSGGGSGGGGSGGGGSGGGSG GEVQLQQSGAEVKKPGATVKLSCTASGFNIKDEY INWVKQRPGQGLEWIGWIDPENGDTEYASKFQG RATITADTSTDTAYLELSSLRSEDTAVYYCTGGN YVGWFPYWGQGTLVTVSSGGGGSGGGGSGGGG SQIVLTQSPATLSASPGERVTMSCSASSSVSYMH WYQQKPGTSPRRWLYDTSKLASGVPARFSGSGS GTDYTLTISSLEPEDFATYYCQQWSSNPPYTFGQG TKLEIKGGSGLNDIFEAQKIEWHEGGSHHHHHH (SEQ ID NO: 266) | humanized M1, p35 S27D, C74K, D188N |
| p35-hM1-ScFv(vL4-vH3)2 | RNLPVATPDPGMFPCLHHSQNLLRAVDNMLQKA RQTLEFYPCTSEEIDHEDITKDKTSTVEACLPLELT KNESKLNSRETSFITNGSCLASRKTSFMMALCLSS IYEDLKMYQVEFKTMNAKLLMDPKRQIFLDQNM LAVIDELMQALNFNSETVPQKSSLEEPDFYKTKIK LCILLHAFRIRAVTINRVMSYLNASGGGGSGGGG SQIVLTQSPATLSASPGERVTMSCSASSSVSYMH WYQQKPGTSPRRWLYDTSKLASGVPARFSGSGS GTDYTLTISSLEPEDFATYYCQQWSSNPPYTFGQG TKLEIKGGGGSGGGGSGGGGSEVQLQQSGAEVK KPGATVKLSCTASGFNIKDEYINWVKQRPGQGLE WIGWIDPENGDTEYASKFQGRATITADTSTDTAY LELSSLRSEDTAVYYCTGGNYVGWFPYWGQGTL VTVSSGGSGGGGSGGGSGGGGSGGGGSGGGSGG QIVLTQSPATLSASPGERVTMSCSASSSVSYMHW YQQKPGTSPRRWLYDTSKLASGVPARFSGSGSGT DYTLTISSLEPEDFATYYCQQWSSNPPYTFGQGTK LEIKGGGGSGGGGSGGGGSEVQLQQSGAEVKKP GATVKLSCTASGFNIKDEYINWVKQRPGQGLEWI GWIDPENGDTEYASKFQGRATITADTSTDTAYLE LSSLRSEDTAVYYCTGGNYVGWFPYWGQGTLVT VSSGGSGLNDIFEAQKIEWHEGGSHHHHHH (SEQ ID NO: 190) | humanized M1, p35 S27D, C74K, D188N |
| P35-M1-ScFv (H3L1)2 | RNLPVATPDPGMFPCLHHSQNLLRAVDNMLQKA RQTLEFYPCTSEEIDHEDITKDKTSTVEACLPLELT KNESKLNSRETSFITNGSCLASRKTSFMMALCLSS IYEDLKMYQVEFKTMNAKLLMDPKRQIFLDQNM LAVIDELMQALNFNSETVPQKSSLEEPDFYKTKIK LCILLHAFRIRAVTINRVMSYLNASGGGGSGGGG SEVQLQQSGAEVKKPGATVKLSCTASGFNIKDEY INWVKQRPGQGLEWIGWIDPENGDTEYASKFQG RATITADTSTDTAYLELSSLRSEDTAVYYCTGGN YVGWFPYWGQGTLVTVSSGGGGSGGGGSGGGG SEIVLTQSPATLSLSPGERATLSCSASSSVSYMHW YQQKPGTSPRRWIYDTSKLASGVPARFSGSGSGT DFTLTISSLEPEDFAVYYCQQWSSNPPYTFGQGTK LEIKGGSGGGGSGGGSGGGGSGGGGSGGGSGGE VQLQQSGAEVKKPGATVKLSCTASGFNIKDEYIN WVKQRPGQGLEWIGWIDPENGDTEYASKFQGRA TITADTSTDTAYLELSSLRSEDTAVYYCTGGNYV GWFPYWGQGTLVTVSSGGGGSGGGGSGGGGSEI VLTQSPATLSLSPGERATLSCSASSSVSYMHWYQ QKPGTSPRRWIYDTSKLASGVPARFSGSGSGTDFT LTISSLEPEDFAVYYCQQWSSNPPYTFGQGTKLEI KGGSGLNDIFEAQKIEWHEGGSHHHHHH (SEQ ID NO: 191) | humanized M1, p35 S27D, C74K, D188N |

TABLE 28-continued

Humanized M1 antibody-IL-12 subunit fusion amino acid sequences

| Description | Sequence | Notes |
|---|---|---|
| M1-ScFv(H3L1)-Fc(knob) | EVQLQQSGAEVKKPGATVKLSCTASGFNIKDEYI<br>NWVKQRPGQGLEWIGWIDPENGDTEYASKFQGR<br>ATITADTSTDTAYLELSSLRSEDTAVYYCTGGNY<br>VGWFPYWGQGTLVTVSSGGGGSGGGGSGGGGS<br>EIVLTQSPATLSLSPGERATLSCSASSSVSYMHWY<br>QQKPGTSPRRWIYDTSKLASGVPARFSGSGSGTD<br>FTLTISSLEPEDFAVYYCQQWSSNPPYTFGQGTKL<br>EIKGGGGSGGGGSEPKSSDKTHTCPPCPAPEAAG<br>GPSVFLFPPKPKDTLMISRTPEVTCVVVDVSHEDP<br>EVKFNWYVDGVEVHNAKTKPREEQYNSTYRVVS<br>VLTVLHQDWLNGKEYKCKVSNKALGAPIEKTISK<br>AKGQPREPQVCTLPPSREEMTKNQVSLWCLVKG<br>FYPSDIAVEWESNGQPENNYKTTPPVLDSDGSFFL<br>YSKLTVDKSRWQQGNVFSCSVMHEALHNHYTQ<br>KSLSLSPGK (SEQ ID NO: 192) | humanized M1, Knob T366W, human IgG1, LALA-PG, effector function null |

TABLE 29

Humanized M8 antibody-IL-12 subunit fusion amino acid sequences

| Description | Sequence | Notes |
|---|---|---|
| hM8-IgG1(H3)-p40 | QIQLVQSGSELKKPGASVKISCKASGTTFTDYGM<br>NWVKQSPGKGLKWMGWINTNTGEPTYAEDFKG<br>RFVFSLDTSVSTAYLQISSLKAEDTATYFCAHYSF<br>DYWGQGTLLTVSSASTKGPSVFPLAPSSKSTSGGT<br>AALGCLVKDYFPEPVTVSWNSGALTSGVHTFPAV<br>LQSSGLYSLSSVVTVPSSSLGTQTYICNVNHKPSN<br>TKVDKKVEPKSCDKTHTCPPCPAPEAAGGPSVFL<br>FPPKPKDTLMISRTPEVTCVVVDVSHEDPEVKFN<br>WYVDGVEVHNAKTKPREEQYNSTYRVVSVLTVL<br>HQDWLNGKEYKCKVSNKALPAPIEKTISKAKGQP<br>REPQVYTLPPSRDELTKNQVSLTCLVKGFYPSDIA<br>VEWESNGQPENNYKTTPPVLDSDGSFFLYSKLTV<br>DKSRWQQGNVFSCSVMHEALHNHYTQKSLSLSP<br>GKGGGGSGGGGSIWELKKDVYVVELDWYPDAP<br>GEMVVLTCDTPEEDGITWTLDQSSEVLGSGKTLTI<br>QVKEFGDAGQYTCHKGGEVLSHSLLLLHKKEDGI<br>WSTDILKDQKEPKNKTFLRCEAKNYSGRFTCWW<br>LTTISTDLTFSVKSSRGSSDPQGVTCGAATLSAER<br>VRGDNKEYEYSVECQEDSASPAAEESLPIEVMVD<br>AVHKLKYENYTSSFFIRDIIKPDPPKNLQLKPLKNS<br>RQVEVSWEYPDTWSTPHSYFSLTFSVQVQGKSKR<br>EKKDRVFTDKTSATVICRKNASISVRAQDRYYSSS<br>WSEWASVPCS (SEQ ID NO: 193) | humanized M8 LALA, p40 C177S |
| hM8-Fab(H3)-p40 | QIQLVQSGSELKKPGASVKISCKASGTTFTDYGM<br>NWVKQSPGKGLKWMGWINTNTGEPTYAEDFKG<br>RFVFSLDTSVSTAYLQISSLKAEDTATYFCAHYSF<br>DYWGQGTLLTVSSASTKGPSVFPLAPSSKSTSGGT<br>AALGCLVKDYFPEPVTVSWNSGALTSGVHTFPAV<br>LQSSGLYSLSSVVTVPSSSLGTQTYICNVNHKPSN<br>TKVDKKVEPKSCGGGGSGGGGSIWELKKDVYVV<br>ELDWYPDAPGEMVVLTCDTPEEDGITWTLDQSSE<br>VLGSGKTLTIQVKEFGDAGQYTCHKGGEVLSHSL<br>LLLHKKEDGIWSTDILKDQKEPKNKTFLRCEAKN<br>YSGRFTCWWLTTISTDLTFSVKSSRGSSDPQGVTC<br>GAATLSAERVRGDNKEYEYSVECQEDSASPAAEE<br>SLPIEVMVDAVHKLKYENYTSSFFIRDIIKPDPPKN<br>LQLKPLKNSRQVEVSWEYPDTWSTPHSYFSLTFS<br>VQVQGKSKREKKDRVFTDKTSATVICRKNASISV<br>RAQDRYYSSSWSEWASVPCSGGSGLNDIFEAQKI<br>EWHEGSHHHHHH (SEQ ID NO: 267) | humanized M8, p40 C177S |
| hM8-Fab(h3)-Fc(Knob) | QIQLVQSGSELKKPGASVKISCKASGTTFTDYGM<br>NWVKQSPGKGLKWMGWINTNTGEPTYAEDFKG<br>RFVFSLDTSVSTAYLQISSLKAEDTATYFCAHYSF<br>DYWGQGTLLTVSSASTKGPSVFPLAPSSKSTSGGT<br>AALGCLVKDYFPEPVTVSWNSGALTSGVHTFPAV<br>LQSSGLYSLSSVVTVPSSSLGTQTYICNVNHKPSN<br>TKVDKKVEPKSCGGGGSGGGGSEPKSSDKTHTCP<br>PCPAPEAAGGPSVFLFPPKPKDTLMISRTPEVTCV | humanized M8, Knob T366W, human IgG1, LALA-PG, effector function null |

TABLE 29-continued

Humanized M8 antibody-IL-12 subunit fusion amino acid sequences

| Description | Sequence | Notes |
| --- | --- | --- |
| | VVDVSHEDPEVKFNWYVDGVEVHNAKTKPREEQ<br>YNSTYRVVSVLTVLHQDWLNGKEYKCKVSNKAL<br>GAPIEKTISKAKGQPREPQVCTLPPSREEMTKNQV<br>SLWCLVKGFYPSDIAVEWESNGQPENNYKTTPPV<br>LDSDGSFFLYSKLTVDKSRWQQGNVFSCSVMHE<br>ALHNHYTQKSLSLSPGK (SEQ ID NO: 195) | |
| hM8-ScFv(vH3-vL2B2)-p40 | QIQLVQSGSELKKPGASVKISCKASGTTFTDYGM<br>NWVKQSPGKGLKWMGWINTNTGEPTYAEDFKG<br>RFVFSLDTSVSTAYLQISSLKAEDTATYFCAHYSF<br>DYWGQGTLLTVSSGGGGSGGGGSGGGGSDIQMT<br>QSPSSLSASVGDTVTITCRTSENIYSNLAWYQQKP<br>GKSPQLLVYAATNLADGVPSRFSGSGSGTQYTLK<br>ISSLQPEDFATYYCQHFWGTPWTFGGGTKVEIKG<br>GGGSGGGGSIWELKKDVYVVELDWYPDAPGEM<br>VVLTCDTPEEDGITWTLDQSSEVLGSGKTLTIQVK<br>EFGDAGQYTCHKGGEVLSHSLLLLHKKEDGIWST<br>DILKDQKEPKNKTFLRCEAKNYSGRFTCWWLTTI<br>STDLTFSVKSSRGSSDPQGVTCGAATLSAERVRG<br>DNKEYEYSVECQEDSASPAAEESLPIEVMVDAVH<br>KLKYENYTSSFFIRDIIKPDPPKNLQLKPLKNSRQV<br>EVSWEYPDTWSTPHSYFSLTFSVQVQGKSKREKK<br>DRVFTDKTSATVICRKNASISVRAQDRYYSSSWSE<br>WASVPCSGGSGLNDIFEAQKIEWHEGGSHHHHH<br>H (SEQ ID NO: 196) | humanized M8, p40 C177S |
| hM8-ScFv(vL2B2-vH3)-p40 | DIQMTQSPSSLSASVGDTVTITCRTSENIYSNLAW<br>YQQKPGKSPQLLVYAATNLADGVPSRFSGSGSGT<br>QYTLKISSLQPEDFATYYCQHFWGTPWTFGGGTK<br>VEIKGGGGSGGGGSGGGGSQIQLVQSGSELKKPG<br>ASVKISCKASGTTFTDYGMNWVKQSPGKGLKW<br>MGWINTNTGEPTYAEDFKGRFVFSLDTSVSTAYL<br>QISSLKAEDTATYFCAHYSFDYWGQGTLLTVSSG<br>GGGSGGGGSIWELKKDVYVVELDWYPDAPGEM<br>VVLTCDTPEEDGITWTLDQSSEVLGSGKTLTIQVK<br>EFGDAGQYTCHKGGEVLSHSLLLLHKKEDGIWST<br>DILKDQKEPKNKTFLRCEAKNYSGRFTCWWLTTI<br>STDLTFSVKSSRGSSDPQGVTCGAATLSAERVRG<br>DNKEYEYSVECQEDSASPAAEESLPIEVMVDAVH<br>KLKYENYTSSFFIRDIIKPDPPKNLQLKPLKNSRQV<br>EVSWEYPDTWSTPHSYFSLTFSVQVQGKSKREKK<br>DRVFTDKTSATVICRKNASISVRAQDRYYSSSWSE<br>WASVPCSGGSGLNDIFEAQKIEWHEGGSHHHHH<br>H (SEQ ID NO: 197) | humanized M8, p40 C177S |
| hM8-ScFv(vH3-vL2B2)-Fc(knob) | QIQLVQSGSELKKPGASVKISCKASGTTFTDYGM<br>NWVKQSPGKGLKWMGWINTNTGEPTYAEDFKG<br>RFVFSLDTSVSTAYLQISSLKAEDTATYFCAHYSF<br>DYWGQGTLLTVSSGGGGSGGGGSGGGGSDIQMT<br>QSPSSLSASVGDTVTITCRTSENIYSNLAWYQQKP<br>GKSPQLLVYAATNLADGVPSRFSGSGSGTQYTLK<br>ISSLQPEDFATYYCQHFWGTPWTFGGGTKVEIKG<br>GGGSGGGGSEPKSSDKTHTCPPCPAPEAAGGPSV<br>FLFPPKPKDTLMISRTPEVTCVVVDVSHEDPEVKF<br>NWYVDGVEVHNAKTKPREEQYNSTYRVVSVLTV<br>LHQDWLNGKEYKCKVSNKALGAPIEKTISKAKG<br>QPREPQVCTLPPSREEMTKNQVSLWCLVKGFYPS<br>DIAVEWESNGQPENNYKTTPPVLDSDGSFFLYSK<br>LTVDKSRWQQGNVFSCSVMHEALHNHYTQKSLS<br>LSPGK (SEQ ID NO: 198) | humanized M8, Knob T366W, human IgG1, LALA-PG, effector function null |
| hM8-ScFv(vL2B2-vH3)-Fc(knob) | DIQMTQSPSSLSASVGDTVTITCRTSENIYSNLAW<br>YQQKPGKSPQLLVYAATNLADGVPSRFSGSGSGT<br>QYTLKISSLQPEDFATYYCQHFWGTPWTFGGGTK<br>VEIKGGGGSGGGGSGGGGSQIQLVQSGSELKKPG<br>ASVKISCKASGTTFTDYGMNWVKQSPGKGLKW<br>MGWINTNTGEPTYAEDFKGRFVFSLDTSVSTAYL<br>QISSLKAEDTATYFCAHYSFDYWGQGTLLTVSSG<br>GGGSGGGGSEPKSSDKTHTCPPCPAPEAAGGPSV<br>FLFPPKPKDTLMISRTPEVTCVVVDVSHEDPEVKF<br>NWYVDGVEVHNAKTKPREEQYNSTYRVVSVLTV<br>LHQDWLNGKEYKCKVSNKALGAPIEKTISKAKG<br>QPREPQVCTLPPSREEMTKNQVSLWCLVKGFYPS<br>DIAVEWESNGQPENNYKTTPPVLDSDGSFFLYSK<br>LTVDKSRWQQGNVFSCSVMHEALHNHYTQKSLS<br>LSPGK (SEQ ID NO: 199) | humanized M8, Knob T366W, human IgG1, LALA-PG, effector function null |

TABLE 29-continued

Humanized M8 antibody-IL-12 subunit fusion amino acid sequences

| Description | Sequence | Notes |
| --- | --- | --- |
| p35-hM8-ScFv(vH3-vL2B2) | RNLPVATPDPGMFPCLHHSQNLLRAVDNMLQKA RQTLEFYPCTSEEIDHEDITKDKTSTVEACLPLELT KNESKLNSRETSFITNGSCLASRKTSFMMALCLSSI YEDLKMYQVEFKTMNAKLLMDPKRQIFLDQNML AVIDELMQALNFNSETVPQKSSLEEPDFYKTKIKL CILLHAFRIRAVTINRVMSYLNASGGGGSGGGGS QIQLVQSGSELKKPGASVKISCKASGTTFTDYGM NWVKQSPGKGLKWMGWINTNTGEPTYAEDFKG RFVFSLDTSVSTAYLQISSLKAEDTATYFCAHYSF DYWGQGTLLTVSSGGGGSGGGGSGGGGSDIQMT QSPSSLSASVGDTVTITCRTSENIYSNLAWYQQKP GKSPQLLVYAATNLADGVPSRFSGSGSGTQYTLK ISSLQPEDFATYYCQHFWGTPWTFGGGTKVEIKG GSGGGGSGGGGSGGGGSGGGSGGGSGGQIQLVQ SGSELKKPGASVKISCKASGTTFTDYGMNWVKQS PGKGLKWMGWINTNTGEPTYAEDFKGRFVFSLD TSVSTAYLQISSLKAEDTATYFCAHYSFDYWGQG TLLTVSSGGGGSGGGGSGGGGSDIQMTQSPSSLS ASVGDTVTITCRTSENIYSNLAWYQQKPGKSPQL LVYAATNLADGVPSRFSGSGSGTQYTLKISSLQPE DFATYYCQHFWGTPWTFGGGTKVEIKGGSGLNDI FEAQKIEWHEGGSHHHHHH (SEQ ID NO: 200) | humanized M8, p35 S27D, C74K, D188N |
| p35-hM8-ScFv(vL2B2-vH3) | RNLPVATPDPGMFPCLHHSQNLLRAVDNMLQKA RQTLEFYPCTSEEIDHEDITKDKTSTVEACLPLELT KNESKLNSRETSFITNGSCLASRKTSFMMALCLSSI YEDLKMYQVEFKTMNAKLLMDPKRQIFLDQNML AVIDELMQALNFNSETVPQKSSLEEPDFYKTKIKL CILLHAFRIRAVTINRVMSYLNASGGGGSGGGGS DIQMTQSPSSLSASVGDTVTITCRTSENIYSNLAW YQQKPGKSPQLLVYAATNLADGVPSRFSGSGSGT QYTLKISSLQPEDFATYYCQHFWGTPWTFGGGTK VEIKGGGGSGGGGSGGGGSQIQLVQSGSELKKPG ASVKISCKASGTTFTDYGMNWVKQSPGKGLKW MGWINTNTGEPTYAEDFKGRFVFSLDTSVSTAYL QISSLKAEDTATYFCAHYSFDYWGQGTLLTVSSG GSGGGGSGGGGSGGGGSGGGSGGGSGGDIQMTQ SPSSLSASVGDTVTITCRTSENIYSNLAWYQQKPG KSPQLLVYAATNLADGVPSRFSGSGSGTQYTLKIS SLQPEDFATYYCQHFWGTPWTFGGGTKVEIKGG GSGGGGSGGGGSQIQLVQSGSELKKPGASVKIS CKASGTTFTDYGMNWVKQSPGKGLKWMGWINT NTGEPTYAEDFKGRFVFSLDTSVSTAYLQISSLKA EDTATYFCAHYSFDYWGQGTLLTVSSGGGSLNDI FEAQKIEWHEGGSHHHHHH (SEQ ID NO: 201) | humanized M8, p35 S27D, C74K, D188N |
| hM8-ScFv(vH3-vL2B5)-p40 | QIQLVQSGSELKKPGASVKISCKASGTTFTDYGM NWVKQSPGKGLKWMGWINTNTGEPTYAEDFKG RFVFSLDTSVSTAYLQISSLKAEDTATYFCAHYSF DYWGQGTLLTVSSGGGGSGGGGSGGGGSDIQMT QSPSSLSASVGDRVTITCRTSENIYSNLAWYQQKP GKSPQLLVYAATNLADGVPSRFSGSGSGTDYTLTI SSLQPEDFGTYYCQHFWGTPWTFGGGTKVEIKGG GSGGGGSIWELKKDVYVVELDWYPDAPGEMV VLTCDTPEEDGITWTLDQSSEVLGSGKTLTIQVKE FGDAGQYTCHKGGEVLSHSLLLLHKKEDGIWSTD ILKDQKEPKNKTFLRCEAKNYSGRFTCWWLTTIS TDLTFSVKSSRGSSDPQGVTCGAATLSAERVRGD NKEYEYSVECQEDSASPAAEESLPIEVMVDAVHK LKYENYTSSFFIRDIIKPDPPKNLQLKPLKNSRQVE VSWEYPDTWSTPHSYFSLTFSVQVQGKSREKKD RVFTDKTSATVICRKNASISVRAQDRYYSSSWSE WASVPCSGGSGLNDIFEAQKIEWHEGGSHHHHH H (SEQ ID NO: 202) | humanized M8, p40 C177S |
| hM8-ScFv(vL2B5-vH3)-p40 | DIQMTQSPSSLSASVGDRVTITCRTSENIYSNLAW YQQKPGKSPQLLVYAATNLADGVPSRFSGSGSGT DYTLTISSLQPEDFGTYYCQHFWGTPWTFGGGTK VEIKGGGGSGGGGSGGGGSQIQLVQSGSELKKPG ASVKISCKASGTTFTDYGMNWVKQSPGKGLKW MGWINTNTGEPTYAEDFKGRFVFSLDTSVSTAYL QISSLKAEDTATYFCAHYSFDYWGQGTLLTVSSG GGGSGGGGSIWELKKDVYVVELDWYPDAPGEM VVLTCDTPEEDGITWTLDQSSEVLGSGKTLTIQVK EFGDAGQYTCHKGGEVLSHSLLLLHKKEDGIWST | humanized M8, p40 C177S |

TABLE 29-continued

Humanized M8 antibody-IL-12 subunit fusion amino acid sequences

| Description | Sequence | Notes |
| --- | --- | --- |
| | DILKDQKEPKNKTFLRCEAKNYSGRFTCWWLTTI STDLTFSVKSSRGSSDPQGVTCGAATLSAERVRG DNKEYEYSVECQEDSASPAAEESLPIEVMVDAVH KLKYENYTSSFFIRDIIKPDPPKNLQLKPLKNSRQV EVSWEYPDTWSTPHSYFSLTFSVQVQGKSKREKK DRVFTDKTSATVICRKNASISVRAQDRYYSSSWSE WASVPCSGGSGLNDIFEAQKIEWHEGGSHHHHH H (SEQ ID NO: 203) | |
| hM8-ScFv(vH3-vL2B5)-Fc(knob) | QIQLVQSGSELKKPGASVKISCKASGTTFTDYGM NWVKQSPGKGLKWMGWINTNTGEPTYAEDFKG RFVFSLDTSVSTAYLQISSLKAEDTATYFCAHYSF DYWGQGTLLTVSSGGGGSGGGGSGGGGSDIQMT QSPSSLSASVGDRVTITCRTSENIYSNLAWYQQKP GKSPQLLVYAATNLADGVPSRFSGSGSGTDYTLTI SSLQPEDFGTYYCQHFWGTPWTFGGGTKVEIKGG GGSGGGGSEPKSSDKTHTCPPCPAPEAAGGPSVFL FPPKPKDTLMISRTPEVTCVVVDVSHEDPEVKFN WYVDGVEVHNAKTKPREEQYNSTYRVVSVLTVL HQDWLNGKEYKCKVSNKALGAPIEKTISKAKGQ PREPQVCTLPPSREEMTKNQVSLWCLVKGFYPSDI AVEWESNGQPENNYKTTPPVLDSDGSFFLYSKLT VDKSRWQQGNVFSCSVMHEALHNHYTQKSLSLS PGK (SEQ ID NO: 204) | humanized M8, Knob T366W, human IgG1, LALA-PG, effector function null |
| hM8-ScFv(vL2B5-vH3)-Fc(knob) | DIQMTQSPSSLSASVGDRVTITCRTSENIYSNLAW YQQKPGKSPQLLVYAATNLADGVPSRFSGSGSGT DYTLTISSLQPEDFGTYYCQHFWGTPWTFGGGTK VEIKGGGGSGGGGSGGGGSQIQLVQSGSELKKPG ASVKISCKASGTTFTDYGMNWVKQSPGKGLKW MGWINTNTGEPTYAEDFKGRFVFSLDTSVSTAYL QISSLKAEDTATYFCAHYSFDYWGQGTLLTVSSG GGGSGGGGSEPKSSDKTHTCPPCPAPEAAGGPSV FLFPPKPKDTLMISRTPEVTCVVVDVSHEDPEVKF NWYVDGVEVHNAKTKPREEQYNSTYRVVSVLTV LHQDWLNGKEYKCKVSNKALGAPIEKTISKAKG QPREPQVCTLPPSREEMTKNQVSLWCLVKGFYPS DIAVEWESNGQPENNYKTTPPVLDSDGSFFLYSK LTVDKSRWQQGNVFSCSVMHEALHNHYTQKSLS LSPGK (SEQ ID NO: 205) | humanized M8, Knob T366W, human IgG1, LALA-PG, effector function null |
| p35-hM8-ScFv(vH3-vL2B5) | RNLPVATPDPGMFPCLHHSQNLLRAVDNMLQKA RQTLEFYPCTSEEIDHEDITKDKTSTVEACLPLELT KNESKLNSRETSFITNGSCLASRKTSFMMALCLSSI YEDLKMYQVEFKTMNAKLLMDPKRQIFLDQNML AVIDELMQALNFNSETVPQKSSLEEPDFYKTKIKL CILLHAFRIRAVTINRVMSYLNASGGGGSGGGGS QIQLVQSGSELKKPGASVKISCKASGTTFTDYGM NWVKQSPGKGLKWMGWINTNTGEPTYAEDFKG RFVFSLDTSVSTAYLQISSLKAEDTATYFCAHYSF DYWGQGTLLTVSSGGGGSGGGGSGGGGSDIQMT QSPSSLSASVGDRVTITCRTSENIYSNLAWYQQKP GKSPQLLVYAATNLADGVPSRFSGSGSGTDYTLTI SSLQPEDFGTYYCQHFWGTPWTFGGGTKVEIKGG SGGGGSGGGSGGGGSGGGGSGGGSGGQIQLVQS GSELKKPGASVKISCKASGTTFTDYGMNWVKQSP GKGLKWMGWINTNTGEPTYAEDFKGRFVFSLDT SVSTAYLQISSLKAEDTATYFCAHYSFDYWGQGT LLTVSSGGGGSGGGGSGGGGSDIQMTQSPSSLSAS VGDRVTITCRTSENIYSNLAWYQQKPGKSPQLLV YAATNLADGVPSRFSGSGSGTDYTLTISSLQPEDF GTYYCQHFWGTPWTFGGGTKVEIKGGSGLNDIFE AQKIEWHEGGSHHHHHH (SEQ ID NO: 206) | 6humanized M8, p35 S27D, C74K, D188N |
| p35-hM8-ScFv(vL2B5-vH3) | RNLPVATPDPGMFPCLHHSQNLLRAVDNMLQKA RQTLEFYPCTSEEIDHEDITKDKTSTVEACLPLELT KNESKLNSRETSFITNGSCLASRKTSFMMALCLSSI YEDLKMYQVEFKTMNAKLLMDPKRQIFLDQNML AVIDELMQALNFNSETVPQKSSLEEPDFYKTKIKL CILLHAFRIRAVTINRVMSYLNASGGGGSGGGGS DIQMTQSPSSLSASVGDRVTITCRTSENIYSNLAW YQQKPGKSPQLLVYAATNLADGVPSRFSGSGSGT DYTLTISSLQPEDFGTYYCQHFWGTPWTFGGGTK VEIKGGGGSGGGGSGGGGSQIQLVQSGSELKKPG ASVKISCKASGTTFTDYGMNWVKQSPGKGLKW MGWINTNTGEPTYAEDFKGRFVFSLDTSVSTAYL | humanized M8, p35 S27D, C74K, D188N |

TABLE 29-continued

Humanized M8 antibody-IL-12 subunit fusion amino acid sequences

| Description | Sequence | Notes |
|---|---|---|
| | QISSLKAEDTATYFCAHYSFDYWGQGTLLTVSSGGSGGGGSGGGSGGGGSGGGGSGGSGGDIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGSGLNDIFEAQKIEWHEGGSHHHHHH (SEQ ID NO: 207) | |
| hM8-ScFv(vH3-vL2B10)-p40 | QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH (SEQ ID NO: 208) | humanized M8, p40 C177S |
| hM8-ScFv(vL2B10-vH3)-p40 | DIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH (SEQ ID NO: 209) | humanized M8, p40 C177S |
| hM8-ScFv(vH3-vL2B10)-Fc(knob) | QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK (SEQ ID NO: 210) | humanized M8, Knob T366W, human IgG1, LALA-PG, effector function null |
| hM8-ScFv(vL2B10-vH3)-Fc(knob) | DIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKG | humanized M8, Knob T366W, human IgG1, LALA-PG, effector function null |

TABLE 29-continued

Humanized M8 antibody-IL-12 subunit fusion amino acid sequences

| Description | Sequence | Notes |
|---|---|---|
| | QPREPQVCTLPPSREEMTKNQVSLWCLVKGFYPS<br>DIAVEWESNGQPENNYKTTPPVLDSDGSFFLYSK<br>LTVDKSRWQQGNVFSCSVMHEALHNHYTQKSLS<br>LSPGK (SEQ ID NO: 211) | |
| p35-hM8-<br>ScFv(vH3-<br>VL2B10) | RNLPVATPDPGMFPCLHHSQNLLRAVDNMLQKA<br>RQTLEFYPCTSEEIDHEDITKDKTSTVEACLPLELT<br>KNESKLNSRETSFITNGSCLASRKTSFMMALCLSSI<br>YEDLKMYQVEFKTMNAKLLMDPKRQIFLDQNML<br>AVIDELMQALNFNSETVPQKSSLEEPDFYKTKIKL<br>CILLHAFRIRAVTINRVMSYLNASGGGGSGGGGS<br>QIQLVQSGSELKKPGASVKISCKASGTTFTDYGM<br>NWVKQSPGKGLKWMGWINTNTGEPTYAEDFKG<br>RFVFSLDTSVSTAYLQISSLKAEDTATYFCAHYSF<br>DYWGQGTLLTVSSGGGGSGGGGSGGGGSDIQMT<br>QSPSSLSASVGDTVTITCRTSENIYSNLAWYQQKP<br>GKSPQLLVYAATNLADGVPSRFSGSGSGTDYTLTI<br>SSLQPEDFGTYYCQHFWGTPWTFGGGTKVEIKGG<br>SGGGGSGGGSGGGGSGGGGSGGGSGGQIQLVQS<br>GSELKKPGASVKISCKASGTTFTDYGMNWVKQSP<br>GKGLKWMGWINTNTGEPTYAEDFKGRFVFSLDT<br>SVSTAYLQISSLKAEDTATYFCAHYSFDYWGQGT<br>LLTVSSGGGGSGGGGSGGGGSDIQMTQSPSSLSAS<br>VGDTVTITCRTSENIYSNLAWYQQKPGKSPQLLV<br>YAATNLADGVPSRFSGSGSGTDYTLTISSLQPEDF<br>GTYYCQHFWGTPWTFGGGTKVEIKGGSGLNDIFE<br>AQKIEWHEGGSHHHHHH (SEQ ID NO: 212) | humanized M8, p35<br>S27D, C74K, D188N |
| p35-hM8-<br>ScFv(vL2B10-<br>vH3) | RNLPVATPDPGMFPCLHHSQNLLRAVDNMLQKA<br>RQTLEFYPCTSEEIDHEDITKDKTSTVEACLPLELT<br>KNESKLNSRETSFITNGSCLASRKTSFMMALCLSSI<br>YEDLKMYQVEFKTMNAKLLMDPKRQIFLDQNML<br>AVIDELMQALNFNSETVPQKSSLEEPDFYKTKIKL<br>CILLHAFRIRAVTINRVMSYLNASGGGGSGGGGS<br>DIQMTQSPSSLSASVGDTVTITCRTSENIYSNLAW<br>YQQKPGKSPQLLVYAATNLADGVPSRFSGSGSGT<br>DYTLTISSLQPEDFGTYYCQHFWGTPWTFGGGTK<br>VEIKGGGGSGGGGSGGGGSQIQLVQSGSELKKPG<br>ASVKISCKASGTTFTDYGMNWVKQSPGKGLKW<br>MGWINTNTGEPTYAEDFKGRFVFSLDTSVSTAYL<br>QISSLKAEDTATYFCAHYSFDYWGQGTLLTVSSG<br>GSGGGGSGGGSGGGGSGGGGSGGGSGGDIQMTQ<br>SPSSLSASVGDTVTITCRTSENIYSNLAWYQQKPG<br>KSPQLLVYAATNLADGVPSRFSGSGSGTDYTLTIS<br>SLQPEDFGTYYCQHFWGTPWTFGGGTKVEIKGG<br>GGSGGGGSGGGGSQIQLVQSGSELKKPGASVKIS<br>CKASGTTFTDYGMNWVKQSPGKGLKWMGWINT<br>NTGEPTYAEDFKGRFVFSLDTSVSTAYLQISSLKA<br>EDTATYFCAHYSFDYWGQGTLLTVSSGGSGLNDI<br>FEAQKIEWHEGGSHHHHHH (SEQ ID NO: 268) | humanized M8, p35<br>S27D, C74K, D188N |
| hM8-IgG1(H3)-<br>scIL12 | QIQLVQSGSELKKPGASVKISCKASGTTFTDYGM<br>NWVKQSPGKGLKWMGWINTNTGEPTYAEDFKG<br>RFVFSLDTSVSTAYLQISSLKAEDTATYFCAHYSF<br>DYWGQGTLLTVSSASTKGPSVFPLAPSSKSTSGGT<br>AALGCLVKDYFPEPVTVSWNSGALTSGVHTFPAV<br>LQSSGLYSLSSVVTVPSSSLGTQTYICNVNHKPSN<br>TKVDKKVEPKSCDKTHTCPPCPAPEAAGGPSVFL<br>FPPKPKDTLMISRTPEVTCVVVDVSHEDPEVKFN<br>WYVDGVEVHNAKTKPREEQYNSTYRVVSVLTVL<br>HQDWLNGKEYKCKVSNKALPAPIEKTISKAKGQP<br>REPQVYTLPPSRDELTKNQVSLTCLVKGFYPSDIA<br>VEWESNGQPENNYKTTPPVLDSDGSFFLYSKLTV<br>DKSRWQQGNVFSCSVMHEALHNHYTQKSLSLSP<br>GKGGGGSGGGGSIWELKKDVYVVELDWYPDAP<br>GEMVVLTCDTPEEDGITWTLDQSSEVLGSGKTLTI<br>QVKEFGDAGQYTCHKGGEVLSHSLLLLHKKEDGI<br>WSTDILKDQKEPKNKTFLRCEAKNYSGRFTCWW<br>LTTISTDLTFSVKSSRGSSDPQGVTCGAATLSAER<br>VRGDNKEYEYSVECQEDSACPAAEESLPIEVMVD<br>AVHKLKYENYTSSFFIRDIIKPDPPKNLQLKPLKNS<br>RQVEVSWEYPDTWSTPHSYFSLTFCVQVQGKSKR<br>EKKDRVFTDKTSATVICRKNASISVRAQDRYYSSS<br>WSEWASVPCSGGSGGGGSGGRNLPVATPDPGMF<br>PCLHHSQNLLRAVSNMLQKARQTLEFYPCTSEEI<br>DHEDITKDKTSTVEACLPLELTKNESCLNSRETSFI | humanized M8 LALA,<br>p40-p35 |

TABLE 29-continued

Humanized M8 antibody-IL-12 subunit fusion amino acid sequences

| Description | Sequence | Notes |
|---|---|---|
| | TNGSCLASRKTSFMMALCLSSIYEDLKMYQVEFK<br>TMNAKLLMDPKRQIFLDQNMLAVIDELMQALNF<br>NSETVPQKSSLEEPDFYKTKIKLCILLHAFRIRAVT<br>IDRVMSYLNAS (SEQ ID NO: 214) | |
| hM8-Fab(H3)-<br>scIL12 | QIQLVQSGSELKKPGASVKISCKASGTTFTDYGM<br>NWVKQSPGKGLKWMGWINTNTGEPTYAEDFKG<br>RFVFSLDTSVSTAYLQISSLKAEDTATYFCAHYSF<br>DYWGQGTLLTVSSASTKGPSVFPLAPSSKSTSGGT<br>AALGCLVKDYFPEPVTVSWNSGALTSGVHTFPAV<br>LQSSGLYSLSSVVTVPSSSLGTQTYICNVNHKPSN<br>TKVDKKVEPKSCGGGGSGGGGSIWELKKDVYVV<br>ELDWYPDAPGEMVVLTCDTPEEDGITWTLDQSSE<br>VLGSGKTLTIQVKEFGDAGQYTCHKGGEVLSHSL<br>LLLHKKEDGIWSTDILKDQKEPKNKTFLRCEAKN<br>YSGRFTCWWLTTISTDLTFSVKSSRGSSDPQGVTC<br>GAATLSAERVRGDNKEYEYSVECQEDSACPAAEE<br>SLPIEVMVDAVHKLKYENYTSSFFIRDIIKPDPPKN<br>LQLKPLKNSRQVEVSWEYPDTWSTPHSYFSLTFC<br>VQVQGKSKREKKDRVFTDKTSATVICRKNASISV<br>RAQDRYYSSSWSEWASVPCSGGSGGGGSGGRNL<br>PVATPDPGMFPCLHHSQNLLRAVSNMLQKARQT<br>LEFYPCTSEEIDHEDITKDKTSTVEACLPLELTKNE<br>SCLNSRETSFITNGSCLASRKTSFMMALCLSSIYED<br>LKMYQVEFKTMNAKLLMDPKRQIFLDQNMLAVI<br>DELMQALNFNSETVPQKSSLEEPDFYKTKIKLCIL<br>LHAFRIRAVTIDRVMSYLNASGGSGGHHHHHHG<br>GSGLNDIFEAQKIEWHE (SEQ ID NO: 215) | humanized M8, p40-<br>p35 |

TABLE 30

Humanized M43 antibody-IL-12 subunit fusion amino acid sequences

| No | Description | Sequence | Notes |
|---|---|---|---|
| 1 | hM43-IgG1(H1)-<br>p40 | QVQLVQSGAEVAKPGASVNLNCKASGYTFTSYGI<br>SWVRQRTGQGLEWIGEIYPRSGNTYYNEKFKGKV<br>TLTTDKSTRTAYMELRSLTSEDTAVYYCAGKDYG<br>STYADYWGQGTTLTVSSASTKGPSVFPLAPSSKS<br>TSGGTAALGCLVKDYFPEPVTVSWNSGALTSGVH<br>TFPAVLQSSGLYSLSSVVTVPSSSLGTQTYICNV<br>NHKPSNTKVDKKVEPKSCDKTHTCPPCPAPEAAG<br>GPSVFLFPPKPKDTLMISRTPEVTCVVVDVSHED<br>PEVKFNWYVDGVEVHNAKTKPREEQYNSTYRVVS<br>VLTVLHQDWLNGKEYKCKVSNKALPAPIEKTISK<br>AKGQPREPQVYTLPPSRDELTKNQVSLTCLVKGF<br>YPSDIAVEWESNGQPENNYKTTPPVLDSDGSFFL<br>YSKLTVDKSRWQQGNVFSCSVMHEALHNHYTQKS<br>LSLSPGKGGGGSGGGGSIWELKKDVYVVELDWYP<br>DAPGEMVVLTCDTPEEDGITWTLDQSSEVLGSGK<br>TLTIQVKEFGDAGQYTCHKGGEVLSHSLLLLHKK<br>EDGIWSTDILKDQKEPKNKTFLRCEAKNYSGRFT<br>CWWLTTISTDLTFSVKSSRGSSDPQGVTCGAATL<br>SAERVRGDNKEYEYSVECQEDSASPAAEESLPIE<br>VMVDAVHKLKYENYTSSFFIRDIIKPDPPKNLQL<br>KPLKNSRQVEVSWEYPDTWSTPHSYFSLTFSVQV<br>QGKSKREKKDRVFTDKTSATVICRKNASISVRAQ<br>DRYYSSSWSEWASVPCS (SEQ ID NO: 216) | humanized M43, p40<br>C177S |
| 2 | hM43-Fab(H1)-<br>p40 | QVQLVQSGAEVAKPGASVNLNCKASGYTFTSYGI<br>SWVRQRTGQGLEWIGEIYPRSGNTYYNEKFKGKV<br>TLTTDKSTRTAYMELRSLTSEDTAVYYCAGKDYG<br>STYADYWGQGTTLTVSSASTKGPSVFPLAPSSKS<br>TSGGTAALGCLVKDYFPEPVTVSWNSGALTSGVH<br>TFPAVLQSSGLYSLSSVVTVPSSSLGTQTYICNV<br>NHKPSNTKVDKKVEPKSCGGGGSGGGGSIWELKK<br>DVYVVELDWYPDAPGEMVVLTCDTPEEDGITWTL<br>DQSSEVLGSGKTLTIQVKEFGDAGQYTCHKGGEV<br>LSHSLLLLHKKEDGIWSTDILKDQKEPKNKTFLR<br>CEAKNYSGRFTCWWLTTISTDLTFSVKSSRGSSD<br>PQGVTCGAATLSAERVRGDNKEYEYSVECQEDSA<br>SPAAEESLPIEVMVDAVHKLKYENYTSSFFIRDI<br>IKPDPPKNLQLKPLKNSRQVEVSWEYPDTWSTPH | humanized M43, p40<br>C177S |

TABLE 30-continued

Humanized M43 antibody-IL-12 subunit fusion amino acid sequences

| No | Description | Sequence | Notes |
|---|---|---|---|
| | | SYFSLTFSVQVQGKSKREKKDRVFTDKTSATVIC RKNASISVRAQDRYYSSSWSEWASVPCSGGSGLN DIFEAQKIEWHEGGSHHHHHH (SEQ ID NO: 217) | |
| 3 | hM43-ScFv(vH1-vL4)-p40 | QVQLVQSGAEVAKPGASVNLNCKASGYTFTSYGI SWVRQRTGQGLEWIGEIYPRSGNTYYNEKFKGKV TLTTDKSTRTAYMELRSLTSEDTAVYYCAGKDYG STYADYWGQGTTLTVSSGGGGSGGGGSGGGGSQI VLTQSPATLSASPGERVTMTCSASSSVSSRYLHW YQQKSGASPRLWIYGTSNLASGVPARFSGSGPGT SYTLTISSVEPEDAATYYCQQYHSDPLTFGQGTK LELKGGGGSGGGGSIWELKKDVYVVELDWYPDAP GEMVVLTCDTPEEDGITWTLDQSSEVLGSGKTLT IQVKEFGDAGQYTCHKGGEVLSHSLLLLHKKEDG IWSTDILKDQKEPKNKTFLRCEAKNYSGRFTCWW LTTISTDLTFSVKSSRGSSDPQGVTCGAATLSAE RVRGDNKEYEYSVECQEDSASPAAEESLPIEVMV DAVHKLKYENYTSSFFIRDIIKPDPPKNLQLKPL KNSRQVEVSWEYPDTWSTPHSYFSLTFSVQVQGK SKREKKDRVFTDKTSATVICRKNASISVRAQDRY YSSSWSEWASVPCSGGSGLNDIFEAQKIEWHEGG SHHHHHH (SEQ ID NO: 218) | humanized M43, p40 C177S |
| 4 | hM43-ScFv(vL4-vH1)-p40 | QIVLTQSPATLSASPGERVTMTCSASSSVSSRYL HWYQQKSGASPRLWIYGTSNLASGVPARFSGSGP GTSYTLTISSVEPEDAATYYCQQYHSDPLTFGQG TKLELKGGGGSGGGGSGGGGSQVQLVQSGAEVAK PGASVNLNCKASGYTFTSYGISWVRQRTGQGLEW IGEIYPRSGNTYYNEKFKGKVTLTTDKSTRTAYM ELRSLTSEDTAVYYCAGKDYGSTYADYWGQGTTL TVSSGGGGSGGGGSIWELKKDVYVVELDWYPDAP GEMVVLTCDTPEEDGITWTLDQSSEVLGSGKTLT IQVKEFGDAGQYTCHKGGEVLSHSLLLLHKKEDG IWSTDILKDQKEPKNKTFLRCEAKNYSGRFTCWW LTTISTDLTFSVKSSRGSSDPQGVTCGAATLSAE RVRGDNKEYEYSVECQEDSASPAAEESLPIEVMV DAVHKLKYENYTSSFFIRDIIKPDPPKNLQLKPL KNSRQVEVSWEYPDTWSTPHSYFSLTFSVQVQGK SKREKKDRVFTDKTSATVICRKNASISVRAQDRY YSSSWSEWASVPCSGGSGLNDIFEAQKIEWHEGG SHHHHHH (SEQ ID NO: 219) | humanized M43, p40 C177S |
| 5 | hM43-Fab(H1)-Fc(knob) | QVQLVQSGAEVAKPGASVNLNCKASGYTFTSYGI SWVRQRTGQGLEWIGEIYPRSGNTYYNEKFKGKV TLTTDKSTRTAYMELRSLTSEDTAVYYCAGKDYG STYADYWGQGTTLTVSSASTKGPSVFPLAPSSKS TSGGTAALGCLVKDYFPEPVTVSWNSGALTSGVH TFPAVLQSSGLYSLSSVVTVPSSSLGTQTYICNV NHKPSNTKVDKKVEPKSCGGGGSGGGGSEPKSSD KTHTCPPCPAPEAAGGPSVFLFPPKPKDTLMISR TPEVTCVVVDVSHEDPEVKFNWYVDGVEVHNAKT KPREEQYNSTYRVVSVLTVLHQDWLNGKEYKCKV SNKALGAPIEKTISKAKGQPREPQVCTLPPSREE MTKNQVSLWCLVKGFYPSDIAVEWESNGQPENNY KTTPPVLDSDGSFFLYSKLTVDKSRWQQGNVFSC SVMHEALHNHYTQKSLSLSPGK (SEQ ID NO: 220) | humanized M43, Knob T366W, human IgG1, LALA-PG, effector function null |
| 6 | hM43-ScFv(vH1-vL4)-Fc(knob) | QVQLVQSGAEVAKPGASVNLNCKASGYTFTSYGI SWVRQRTGQGLEWIGEIYPRSGNTYYNEKFKGKV TLTTDKSTRTAYMELRSLTSEDTAVYYCAGKDYG STYADYWGQGTTLTVSSGGGGSGGGGSGGGGSQI VLTQSPATLSASPGERVTMTCSASSSVSSRYLHW YQQKSGASPRLWIYGTSNLASGVPARFSGSGPGT SYTLTISSVEPEDAATYYCQQYHSDPLTFGQGTK LELKGGGGSGGGGSEPKSSDKTHTCPPCPAPEAA GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALGAPIEKTIS KAKGQPREPQVCTLPPSREEMTKNQVSLWCLVKG FYPSDIAVEWESNGQPENNYKTTPPVLDSDGSFF LYSKLTVDKSRWQQGNVFSCSVMHEALHNHYTQK SLSLSPGK (SEQ ID NO: 221) | humanized M43, Knob T366W, human IgG1, LALA-PG, effector function null |

TABLE 30-continued

Humanized M43 antibody-IL-12 subunit fusion amino acid sequences

| No | Description | Sequence | Notes |
|---|---|---|---|
| 7 | hM43-ScFv(vL4-vH1)-Fc (knob) | QIVLTQSPATLSASPGERVTMTCSASSSVSSRYL HWYQQKSGASPRLWIYGTSNLASGVPARFSGSGP GTSYTLTISSVEPEDAATYYCQQYHSDPLTFGQG TKLELKGGGGSGGGGSGGGGSQVQLVQSGAEVAK PGASVNLNCKASGYTFTSYGISWVRQRTGQGLEW IGEIYPRSGNTYYNEKFKGKVTLTTDKSTRTAYM ELRSLTSEDTAVYYCAGKDYGSTYADYWGQGTTL TVSSGGGGSGGGGSEPKSSDKTHTCPPCPAPEAA GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALGAPIEKTIS KAKGQPREPQVCTLPPSREEMTKNQVSLWCLVKG FYPSDIAVEWESNGQPENNYKTTPPVLDSDGSFF LYSKLTVDKSRWQQGNVFSCSVMHEALHNHYTQK SLSLSPGK (SEQ ID NO: 222) | humanized M43, Knob T366W, human IgG1, LALA-PG, effector function null |
| 8 | p35-hM43-ScFv(vH1-vL4)2 | RNLPVATPDPGMFPCLHHSQNLLRAVDNMLQKAR QTLEFYPCTSEEIDHEDITKDKTSTVEACLPLEL TKNESKLNSRETSFITNGSCLASRKTSFMMALCL SSIYEDLKMYQVEFKTMNAKLLMDPKRQIFLDQN MLAVIDELMQALNFNSETVPQKSSLEEPDFYKTK IKLCILLHAFRIRAVTINRVMSYLNASGGGGSGG GGSQVQLVQSGAEVAKPGASVNLNCKASGYTFTS YGISWVRQRTGQGLEWIGEIYPRSGNTYYNEKFK GKVTLTTDKSTRTAYMELRSLTSEDTAVYYCAGK DYGSTYADYWGQGTTLTVSSGGGGSGGGGSGGGG SQIVLTQSPATLSASPGERVTMTCSASSSVSSRY LHWYQQKSGASPRLWIYGTSNLASGVPARFSGSG PGTSYTLTISSVEPEDAATYYCQQYHSDPLTFGQ GTKLELKGGSGGGGSGGGSGGGGSGGGSGGGGSG GQVQLVQSGAEVAKPGASVNLNCKASGYTFTSYG ISWVRQRTGQGLEWIGEIYPRSGNTYYNEKFKGK VTLTTDKSTRTAYMELRSLTSEDTAVYYCAGKDY GSTYADYWGQGTTLTVSSGGGGSGGGGSGGGGSQ IVLTQSPATLSASPGERVTMTCSASSSVSSRYLH WYQQKSGASPRLWIYGTSNLASGVPARFSGSGPG TSYTLTISSVEPEDAATYYCQQYHSDPLTFGQGT KLELKGGSGLNDIFEAQKIEWHEGGSHHHHHH (SEQ ID NO: 223) | humanized M43, p35 S27D, C74K, D188N |
| 9 | p35-hM43-ScFv(vL4-vH1)2 | RNLPVATPDPGMFPCLHHSQNLLRAVDNMLQKAR QTLEFYPCTSEEIDHEDITKDKTSTVEACLPLEL TKNESKLNSRETSFITNGSCLASRKTSFMMALCL SSIYEDLKMYQVEFKTMNAKLLMDPKRQIFLDQN MLAVIDELMQALNFNSETVPQKSSLEEPDFYKTK IKLCILLHAFRIRAVTINRVMSYLNASGGGGSGG GGSQIVLTQSPATLSASPGERVTMTCSASSSVSS RYLHWYQQKSGASPRLWIYGTSNLASGVPARFSG SGPGTSYTLTISSVEPEDAATYYCQQYHSDPLTF GQGTKLELKGGGGSGGGGSGGGGSQVQLVQSGAE VAKPGASVNLNCKASGYTFTSYGISWVRQRTGQG LEWIGEIYPRSGNTYYNEKFKGKVTLTTDKSTRT AYMELRSLTSEDTAVYYCAGKDYGSTYADYWGQG TTLTVSSGGSGGGGSGGGSGGGGSGGGGSGGGSG GQIVLTQSPATLSASPGERVTMTCSASSSVSSRY LHWYQQKSGASPRLWIYGTSNLASGVPARFSGSG PGTSYTLTISSVEPEDAATYYCQQYHSDPLTFGQ GTKLELKGGGGSGGGGSGGGGSQVQLVQSGAEVA KPGASVNLNCKASGYTFTSYGISWVRQRTGQGLE WIGEIYPRSGNTYYNEKFKGKVTLTTDKSTRTAY MELRSLTSEDTAVYYCAGKDYGSTYADYWGQGTT LTVSSGGSGLNDIFEAQKIEWHEGGSHHHHHH (SEQ ID NO: 224) | humanized M43, p35 S27D, C74K, D188N |
| 10 | hM43-IgG1(H1)-scIL12 | QVQLVQSGAEVAKPGASVNLNCKASGYTFTSYGI SWVRQRTGQGLEWIGEIYPRSGNTYYNEKFKGKV TLTTDKSTRTAYMELRSLTSEDTAVYYCAGKDYG STYADYWGQGTTLTVSSASTKGPSVFPLAPSSKS TSGGTAALGCLVKDYFPEPVTVSWNSGALTSGVH TFPAVLQSSGLYSLSSVVTVPSSSLGTQTYICNV NHKPSNTKVDKKVEPKSCDKTHTCPPCPAPEAAG GPSVFLFPPKPKDTLMISRTPEVTCVVVDVSHED PEVKFNWYVDGVEVHNAKTKPREEQYNSTYRVVS VLTVLHQDWLNGKEYKCKVSNKALPAPIEKTISK AKGQPREPQVYTLPPSRDELTKNQVSLTCLVKGF | humanized M43 LALA, p40-p35 |

TABLE 30-continued

Humanized M43 antibody-IL-12 subunit fusion amino acid sequences

| No | Description | Sequence | Notes |
|---|---|---|---|
| | | YPSDIAVEWESNGQPENNYKTTPPVLDSDGSFFL YSKLTVDKSRWQQGNVFSCSVMHEALHNHYTQKS LSLSPGKGGGGSGGGGSIWELKKDVYVVELDWYP DAPGEMVVLTCDTPEEDGITWTLDQSSEVLGSGK TLTIQVKEFGDAGQYTCHKGGEVLSHSLLLLHKK EDGIWSTDILKDQKEPKNKTFLRCEAKNYSGRFT CWWLTTISTDLTFSVKSSRGSSDPQGVTCGAATL SAERVRGDNKEYEYSVECQEDSACPAAEESLPIE VMVDAVHKLKYENYTSSFFIRDIIKPDPPKNLQL KPLKNSRQVEVSWEYPDTWSTPHSYFSLTFCVQV QGKSKREKKDRVFTDKTSATVICRKNASISVRAQ DRYYSSSWSEWASVPCSGGSGGGGSGGRNLPVAT PDPGMFPCLHHSQNLLRAVSNMLQKARQTLEFYP CTSEEIDHEDITKDKTSTVEACLPLELTKNESCL NSRETSFITNGSCLASRKTSFMMALCLSSIYEDL KMYQVEFKTMNAKLLMDPKRQIFLDQNMLAVIDE LMQALNFNSETVPQKSSLEEPDFYKTKIKLCILL HAFRIRAVTIDRVMSYLNAS (SEQ ID NO: 225) | |
| 11 | hM43-Fab(H1)-scIL12 | QVQLVQSGAEVAKPGASVNLNCKASGYTFTSYGI SWVRQRTGQGLEWIGEIYPRSGNTYYNEKFKGKV TLTTDKSTRTAYMELRSLTSEDTAVYYCAGKDYG STYADYWGQGTTLTVSSASTKGPSVFPLAPSSKS TSGGTAALGCLVKDYFPEPVTVSWNSGALTSGVH TFPAVLQSSGLYSLSSVVTVPSSSLGTQTYICNV NHKPSNTKVDKKVEPKSCGGGGSGGGGSIWELKK DVYVVELDWYPDAPGEMVVLTCDTPEEDGITWTL DQSSEVLGSGKTLTIQVKEFGDAGQYTCHKGGEV LSHSLLLLHKKEDGIWSTDILKDQKEPKNKTFLR CEAKNYSGRFTCWWLTTISTDLTFSVKSSRGSSD PQGVTCGAATLSAERVRGDNKEYEYSVECQEDSA CPAAEESLPIEVMVDAVHKLKYENYTSSFFIRDI IKPDPPKNLQLKPLKNSRQVEVSWEYPDTWSTPH SYFSLTFCVQVQGKSKREKKDRVFTDKTSATVIC RKNASISVRAQDRYYSSSWSEWASVPCSGGSGGG GSGGRNLPVATPDPGMFPCLHHSQNLLRAVSNML QKARQTLEFYPCTSEEIDHEDITKDKTSTVEACL PLELTKNESCLNSRETSFITNGSCLASRKTSFMM ALCLSSIYEDLKMYQVEFKTMNAKLLMDPKRQIF LDQNMLAVIDELMQALNFNSETVPQKSSLEEPDF YKTKIKLCILLHAFRIRAVTIDRVMSYLNASGGS GGHHHHHHGGSGLNDIFEAQKIEWHE (SEQ ID NO: 226) | humanized M43, p40-p35 |
| 12 | hM43-IgG1(H4)-p40 | QVQLQQSGAEVAKPGASVNLNCKASGYTFTSYGI SWVRQRTGQGLEWIGEIYPRSGNTYYNEKFKGKA TLTADKSTRTAYMELRSLTSEDTAVYFCAGKDYG STYADYWGQGTTLTVSSASTKGPSVFPLAPSSKS TSGGTAALGCLVKDYFPEPVTVSWNSGALTSGVH TFPAVLQSSGLYSLSSVVTVPSSSLGTQTYICNV NHKPSNTKVDKKVEPKSCDKTHTCPPCPAPEAAG GPSVFLFPPKPKDTLMISRTPEVTCVVVDVSHED PEVKFNWYVDGVEVHNAKTKPREEQYNSTYRVVS VLTVLHQDWLNGKEYKCKVSNKALPAPIEKTISK AKGQPREPQVYTLPPSRDELTKNQVSLTCLVKGF YPSDIAVEWESNGQPENNYKTTPPVLDSDGSFFL YSKLTVDKSRWQQGNVFSCSVMHEALHNHYTQKS LSLSPGKGGGGSGGGGSIWELKKDVYVVELDWYP DAPGEMVVLTCDTPEEDGITWTLDQSSEVLGSGK TLTIQVKEFGDAGQYTCHKGGEVLSHSLLLLHKK EDGIWSTDILKDQKEPKNKTFLRCEAKNYSGRFT CWWLTTISTDLTFSVKSSRGSSDPQGVTCGAATL SAERVRGDNKEYEYSVECQEDSASPAAEESLPIE VMVDAVHKLKYENYTSSFFIRDIIKPDPPKNLQL KPLKNSRQVEVSWEYPDTWSTPHSYFSLTFSVQV QGKSKREKKDRVFTDKTSATVICRKNASISVRAQ DRYYSSSWSEWASVPCS (SEQ ID NO: 227) | humanized M43, p40 C177S |
| 13 | hM43-Fab(H4)-p40 | QVQLQQSGAEVAKPGASVNLNCKASGYTFTSYGI SWVRQRTGQGLEWIGEIYPRSGNTYYNEKFKGKA TLTADKSTRTAYMELRSLTSEDTAVYFCAGKDYG STYADYWGQGTTLTVSSASTKGPSVFPLAPSSKS TSGGTAALGCLVKDYFPEPVTVSWNSGALTSGVH TFPAVLQSSGLYSLSSVVTVPSSSLGTQTYICNV NHKPSNTKVDKKVEPKSCGGGGSGGGGSIWELKK | humanized M43, p40 C177S |

TABLE 30-continued

Humanized M43 antibody-IL-12 subunit fusion amino acid sequences

| No | Description | Sequence | Notes |
|----|-------------|----------|-------|
| | | DVYVVELDWYPDAPGEMVVLTCDTPEEDGITWTL DQSSEVLGSGKTLTIQVKEFGDAGQYTCHKGGEV LSHSLLLLHKKEDGIWSTDILKDQKEPKNKTFLR CEAKNYSGRFTCWWLTTISTDLTFSVKSSRGSSD PQGVTCGAATLSAERVRGDNKEYEYSVECQEDSA SPAAEESLPIEVMVDAVHKLKYENYTSSFFIRDI IKPDPPKNLQLKPLKNSRQVEVSWEYPDTWSTPH SYFSLTFSVQVQGKSKREKKDRVFTDKTSATVIC RKNASISVRAQDRYYSSSWSEWASVPCSGGSGLN DIFEAQKIEWHEGGSHHHHHH (SEQ ID NO: 228) | |
| 14 | hM43-ScFv(vH4-vL4)-p40 | QVQLQQSGAEVAKPGASVNLNCKASGYTFTSYGI SWVRQRTGQGLEWIGEIYPRSGNTYYNEKFKGKA TLTADKSTRTAYMELRSLTSEDTAVYFCAGKDYG STYADYWGQGTTLTVSSGGGGSGGGGSGGGGSQI VLTQSPATLSASPGERVTMTCSASSSVSSRYLHW YQQKSGASPRLWIYGTSNLASGVPARFSGSGPGT SYTLTISSVEPEDAATYYCQQYHSDPLTFGQGTK LELKGGGGSGGGGSIWELKKDVYVVELDWYPDAP GEMVVLTCDTPEEDGITWTLDQSSEVLGSGKTLT IQVKEFGDAGQYTCHKGGEVLSHSLLLLHKKEDG IWSTDILKDQKEPKNKTFLRCEAKNYSGRFTCWW LTTISTDLTFSVKSSRGSSDPQGVTCGAATLSAE RVRGDNKEYEYSVECQEDSASPAAEESLPIEVMV DAVHKLKYENYTSSFFIRDIIKPDPPKNLQLKPL KNSRQVEVSWEYPDTWSTPHSYFSLTFSVQVQGK SKREKKDRVFTDKTSATVICRKNASISVRAQDRY YSSSWSEWASVPCSGGSGLNDIFEAQKIEWHEGG SHHHHHH (SEQ ID NO: 229) | humanized M43, p40 C177S |
| 15 | hM43-ScFv(vL4-vH4)-p40 | QIVLTQSPATLSASPGERVTMTCSASSSVSSRYL HWYQQKSGASPRLWIYGTSNLASGVPARFSGSGP GTSYTLTISSVEPEDAATYYCQQYHSDPLTFGQG TKLELKGGGGSGGGGSGGGGSQVQLQQSGAEVAK PGASVNLNCKASGYTFTSYGISWVRQRTGQGLEW IGEIYPRSGNTYYNEKFKGKATLTADKSTRTAYM ELRSLTSEDTAVYFCAGKDYGSTYADYWGQGTTL TVSSGGGGSGGGGSIWELKKDVYVVELDWYPDAP GEMVVLTCDTPEEDGITWTLDQSSEVLGSGKTLT IQVKEFGDAGQYTCHKGGEVLSHSLLLLHKKEDG IWSTDILKDQKEPKNKTFLRCEAKNYSGRFTCWW LTTISTDLTFSVKSSRGSSDPQGVTCGAATLSAE RVRGDNKEYEYSVECQEDSASPAAEESLPIEVMV DAVHKLKYENYTSSFFIRDIIKPDPPKNLQLKPL KNSRQVEVSWEYPDTWSTPHSYFSLTFSVQVQGK SKREKKDRVFTDKTSATVICRKNASISVRAQDRY YSSSWSEWASVPCSGGSGLNDIFEAQKIEWHEGG SHHHHHH (SEQ ID NO: 230) | humanized M43, p40 C177S |
| 16 | hM43-Fab(H4)-Fc(knob) | QVQLQQSGAEVAKPGASVNLNCKASGYTFTSYGI SWVRQRTGQGLEWIGEIYPRSGNTYYNEKFKGKA TLTADKSTRTAYMELRSLTSEDTAVYFCAGKDYG STYADYWGQGTTLTVSSASTKGPSVFPLAPSSKS TSGGTAALGCLVKDYFPEPVTVSWNSGALTSGVH TFPAVLQSSGLYSLSSVVTVPSSSLGTQTYICNV NHKPSNTKVDKKVEPKSCGGGGSGGGGSEPKSSD KTHTCPPCPAPEAAGGPSVFLFPPKPKDTLMISR TPEVTCVVVDVSHEDPEVKFNWYVDGVEVHNAKT KPREEQYNSTYRVVSVLTVLHQDWLNGKEYKCKV SNKALGAPIEKTISKAKGQPREPQVCTLPPSREE MTKNQVSLWCLVKGFYPSDIAVEWESNGQPENNY KTTPPVLDSDGSFFLYSKLTVDKSRWQQGNVFSC SVMHEALHNHYTQKSLSLSPGK (SEQ ID NO: 231) | humanized M43, Knob T366W, human IgG1, LALA-PG, effector function null |
| 17 | hM43-ScFv(vH4-vL4)-Fc(knob) | QVQLQQSGAEVAKPGASVNLNCKASGYTFTSYGI SWVRQRTGQGLEWIGEIYPRSGNTYYNEKFKGKA TLTADKSTRTAYMELRSLTSEDTAVYFCAGKDYG STYADYWGQGTTLTVSSGGGGSGGGGSGGGGSQI VLTQSPATLSASPGERVTMTCSASSSVSSRYLHW YQQKSGASPRLWIYGTSNLASGVPARFSGSGPGT SYTLTISSVEPEDAATYYCQQYHSDPLTFGQGTK LELKGGGGSGGGGSEPKSSDKTHTCPPCPAPEAA GGPSVFLFPPKPKDTLMISRTPEVTCVVVDVSHE DPEVKFNWYVDGVEVHNAKTKPREEQYNSTYRVV | humanized M43, Knob T366W, human IgG1, LALA-PG, effector function null |

TABLE 30-continued

Humanized M43 antibody-IL-12 subunit fusion amino acid sequences

| No | Description | Sequence | Notes |
|----|-------------|----------|-------|
| | | SVLTVLHQDWLNGKEYKCKVSNKALGAPIEKTIS<br>KAKGQPREPQVCTLPPSREEMTKNQVSLWCLVKG<br>FYPSDIAVEWESNGQPENNYKTTPPVLDSDGSFF<br>LYSKLTVDKSRWQQGNVFSCSVMHEALHNHYTQK<br>SLSLSPGK (SEQ ID NO: 232) | |
| 18 | hM43-ScFv(vL4-<br>vH4)-Fc (knob) | QIVLTQSPATLSASPGERVTMTCSASSSVSSRYL<br>HWYQQKSGASPRLWIYGTSNLASGVPARFSGSGP<br>GTSYTLTISSVEPEDAATYYCQQYHSDPLTFGQG<br>TKLELKGGGGSGGGGSGGGGSQVQLQQSGAEVAK<br>PGASVNLNCKASGYTFTSYGISWVRQRTGQGLEW<br>IGEIYPRSGNTYYNEKFKGKATLTADKSTRTAYM<br>ELRSLTSEDTAVYFCAGKDYGSTYADYWGQGTTL<br>TVSSGGGGSGGGGSEPKSSDKTHTCPPCPAPEAA<br>GGPSVFLFPPKPKDTLMISRTPEVTCVVVDVSHE<br>DPEVKFNWYVDGVEVHNAKTKPREEQYNSTYRVV<br>SVLTVLHQDWLNGKEYKCKVSNKALGAPIEKTIS<br>KAKGQPREPQVCTLPPSREEMTKNQVSLWCLVKG<br>FYPSDIAVEWESNGQPENNYKTTPPVLDSDGSFF<br>LYSKLTVDKSRWQQGNVFSCSVMHEALHNHYTQK<br>SLSLSPGK (SEQ ID NO: 233) | humanized M43,<br>Knob T366W, human<br>IgG1, LALA-PG,<br>effector function<br>null |
| 19 | p35-hM43-<br>ScFv(vH4-vL4)2 | RNLPVATPDPGMFPCLHHSQNLLRAVDNMLQKAR<br>QTLEFYPCTSEEIDHEDITKDKTSTVEACLPLEL<br>TKNESKLNSRETSFITNGSCLASRKTSFMMALCL<br>SSIYEDLKMYQVEFKTMNAKLLMDPKRQIFLDQN<br>MLAVIDELMQALNFNSETVPQKSSLEEPDFYKTK<br>IKLCILLHAFRIRAVTINRVMSYLNASGGGGSGG<br>GGSQVQLQQSGAEVAKPGASVNLNCKASGYTFTS<br>YGISWVRQRTGQGLEWIGEIYPRSGNTYYNEKFK<br>GKATLTADKSTRTAYMELRSLTSEDTAVYFCAGK<br>DYGSTYADYWGQGTTLTVSSGGGGSGGGGSGGGG<br>SQIVLTQSPATLSASPGERVTMTCSASSSVSSRY<br>LHWYQQKSGASPRLWIYGTSNLASGVPARFSGSG<br>PGTSYTLTISSVEPEDAATYYCQQYHSDPLTFGQ<br>GTKLELKGGSGGGGSGGGGSGGGGSGGGGSGGGSG<br>GQVQLQQSGAEVAKPGASVNLNCKASGYTFTSYG<br>ISWVRQRTGQGLEWIGEIYPRSGNTYYNEKFKGK<br>ATLTADKSTRTAYMELRSLTSEDTAVYFCAGKDY<br>GSTYADYWGQGTTLTVSSGGGGSGGGGSGGGGSQ<br>IVLTQSPATLSASPGERVTMTCSASSSVSSRYLH<br>WYQQKSGASPRLWIYGTSNLASGVPARFSGSGPG<br>TSYTLTISSVEPEDAATYYCQQYHSDPLTFGQGT<br>KLELKGGSGLNDIFEAQKIEWHEGGSHHHHHH<br>(SEQ ID NO: 234) | humanized M43, p35<br>S27D, C74K, D188N |
| 20 | p35-hM43-<br>ScFv(vL4-vH4)2 | RNLPVATPDPGMFPCLHHSQNLLRAVDNMLQKAR<br>QTLEFYPCTSEEIDHEDITKDKTSTVEACLPLEL<br>TKNESKLNSRETSFITNGSCLASRKTSFMMALCL<br>SSIYEDLKMYQVEFKTMNAKLLMDPKRQIFLDQN<br>MLAVIDELMQALNFNSETVPQKSSLEEPDFYKTK<br>IKLCILLHAFRIRAVTINRVMSYLNASGGGGSGG<br>GGSQIVLTQSPATLSASPGERVTMTCSASSSVSS<br>RYLHWYQQKSGASPRLWIYGTSNLASGVPARFSG<br>SGPGTSYTLTISSVEPEDAATYYCQQYHSDPLTF<br>GQGTKLELKGGGGSGGGGSGGGGSQVQLQQSGAE<br>VAKPGASVNLNCKASGYTFTSYGISWVRQRTGQG<br>LEWIGEIYPRSGNTYYNEKFKGKATLTADKSTRT<br>AYMELRSLTSEDTAVYFCAGKDYGSTYADYWGQG<br>TTLTVSSGGSGGGGSGGGSGGGGSGGGGSGGGSG<br>GQIVLTQSPATLSASPGERVTMTCSASSSVSSRY<br>LHWYQQKSGASPRLWIYGTSNLASGVPARFSGSG<br>PGTSYTLTISSVEPEDAATYYCQQYHSDPLTFGQ<br>GTKLELKGGGGSGGGGSGGGGSQVQLQQSGAEVA<br>KPGASVNLNCKASGYTFTSYGISWVRQRTGQGLE<br>WIGEIYPRSGNTYYNEKFKGKATLTADKSTRTAY<br>MELRSLTSEDTAVYFCAGKDYGSTYADYWGQGTT<br>LTVSSGGSGLNDIFEAQKIEWHEGGSHHHHHH<br>(SEQ ID NO: 235) | humanized M43, p35<br>S27D, C74K, D188N |
| 21 | hM43-IgG1(H4)-<br>scIL12 | QVQLQQSGAEVAKPGASVNLNCKASGYTFTSYGI<br>SWVRQRTGQGLEWIGEIYPRSGNTYYNEKFKGKA<br>TLTADKSTRTAYMELRSLTSEDTAVYFCAGKDYG<br>STYADYWGQGTTLTVSSASTKGPSVFPLAPSSKS<br>TSGGTAALGCLVKDYFPEPVTVSWNSGALTSGVH<br>TFPAVLQSSGLYSLSSVVTVPSSSLGTQTYICNV | humanized M43<br>LALA, p40-p35 |

TABLE 30-continued

Humanized M43 antibody-IL-12 subunit fusion amino acid sequences

| No | Description | Sequence | Notes |
|---|---|---|---|
| | | NHKPSNTKVDKKVEPKSCDKTHTCPPCPAPEAAG GPSVFLFPPKPKDTLMISRTPEVTCVVVDVSHED PEVKFNWYVDGVEVHNAKTKPREEQYNSTYRVVS VLTVLHQDWLNGKEYKCKVSNKALPAPIEKTISK AKGQPREPQVYTLPPSRDELTKNQVSLTCLVKGF YPSDIAVEWESNGQPENNYKTTPPVLDSDGSFFL YSKLTVDKSRWQQGNVFSCSVMHEALHNHYTQKS LSLSPGKGGGGSGGGGSIWELKKDVYVVELDWYP DAPGEMVVLTCDTPEEDGITWTLDQSSEVLGSGK TLTIQVKEFGDAGQYTCHKGGEVLSHSLLLLHKK EDGIWSTDILKDQKEPKNKTFLRCEAKNYSGRFT CWWLTTISTDLTFSVKSSRGSSDPQGVTCGAATL SAERVRGDNKEYEYSVECQEDSACPAAEESLPIE VMVDAVHKLKYENYTSSFFIRDIIKPDPPKNLQL KPLKNSRQVEVSWEYPDTWSTPHSYFSLTFCVQV QGKSKREKKDRVFTDKTSATVICRKNASISVRAQ DRYYSSSWSEWASVPCSGGSGGGGSGGRNLPVAT PDPGMFPCLHHSQNLLRAVSNMLQKARQTLEFYP CTSEEIDHEDITKDKTSTVEACLPLELTKNESCL NSRETSFITNGSCLASRKTSFMMALCLSSIYEDL KMYQVEFKTMNAKLLMDPKRQIFLDQNMLAVIDE LMQALNFNSETVPQKSSLEEPDFYKTKIKLCILL HAFRIRAVTIDRVMSYLNAS (SEQ ID NO: 236) | |
| 22 | hM43-Fab(H4)- scIL12 | QVQLQQSGAEVAKPGASVNLNCKASGYTFTSYGI SWVRQRTGQGLEWIGEIYPRSGNTYYNEKFKGKA TLTADKSTRTAYMELRSLTSEDTAVYFCAGKDYG STYADYWGQGTTLTVSSASTKGPSVFPLAPSSKS TSGGTAALGCLVKDYFPEPVTVSWNSGALTSGVH TFPAVLQSSGLYSLSSVVTVPSSSLGTQTYICNV NHKPSNTKVDKKVEPKSCGGGGSGGGGSIWELKK DVYVVELDWYPDAPGEMVVLTCDTPEEDGITWTL DQSSEVLGSGKTLTIQVKEFGDAGQYTCHKGGEV LSHSLLLLHKKEDGIWSTDILKDQKEPKNKTFLR CEAKNYSGRFTCWWLTTISTDLTFSVKSSRGSSD PQGVTCGAATLSAERVRGDNKEYEYSVECQEDSA CPAAEESLPIEVMVDAVHKLKYENYTSSFFIRDI IKPDPPKNLQLKPLKNSRQVEVSWEYPDTWSTPH SYFSLTFCVQVQGKSKREKKDRVFTDKTSATVIC RKNASISVRAQDRYYSSSWSEWASVPCSGGSGGG GSGGGRNLPVATPDPGMFPCLHHSQNLLRAVSNML QKARQTLEFYPCTSEEIDHEDITKDKTSTVEACL PLELTKNESCLNSRETSFITNGSCLASRKTSFMM ALCLSSIYEDLKMYQVEFKTMNAKLLMDPKRQIF LDQNMLAVIDELMQALNFNSETVPQKSSLEEPDF YKTKIKLCILLHAFRIRAVTIDRVMSYLNASGGS GGHHHHHHGGSGLNDIFEAQKIEWHE (SEQ ID NO: 237) | humanized M43, p40-p35 |

Example 6—Additional uPAR Targeting Fusion Proteins

Design, of Fusion Proteins Example 6

Fusion protein constructs designed and/or synthesized in accordance with Example 6 are found in Table 31. Some of these amino acid sequences found in Table 31 are used as controls for the following experimental examples. Sequences involving mouse proteins or human proteins modified for better binding in mouse experiments are included for the purpose of testing in mouse models and mouse cell systems. Any of the constructs using mouse proteins or human proteins modified for mouse experiments may be substituted with fully human proteins.

For expression in mammalian cells, an N-terminal leader sequence was added to certain fusion protein constructs found in Table 31. Also, 6×His (SEQ ID NO: 241) and FLAG tags and avidin polypeptides were added to certain fusion protein constructs found in Table 31 for ease of purification during recombinant procedures.

It is understood that the constructs in Table 31 of fusion proteins of Example 6 may be modified to, for example, modify amino acid compositions or length of the linker molecules between polypeptide molecules without loss of the desired bioactivity. The order of fusion of the various polypeptides may be changes such that, for example, that the uPAR targeting domain region may be at the N-terminus or C-terminus of the cytokine or immune checkpoint modulator portion of the fusion proteins or that other fusion proteins may be added to the constructs in Table 31 via optional linkers such as an Fc fusion protein or a human serum albumin (HAS) fusion protein. Abbreviations in Table 31 include: single chain (sc); circularly permuted (cp) scrambled sequence (ss).

TABLE 31

Amino Acid Sequences Of Polypeptides Described In Example 6

| Description | Amino Acid Sequence/SEQ ID NO |
|---|---|
| Human uPA UniProt: P00749 | MRALLARLLLCVLVVSDSKGSNELHQVPSNCDCLNGGTCVS NKYFSNIHWCNCPKKFGGQHCEIDKSKTCYEGNGHFYRGKA STDTMGRPCLPWNSATVLQQTYHAHRSDALQLGLGKHNYCR NPDNRRRPWCYVQVGLKPLVQECMVHDCADGKKPSSPPEEL KFQCGQKTLRPRFKIIGGEFTTIENQPWFAAIYRRHRGGSV TYVCGGSLISPCWVISATHCFIDYPKKEDYIVYLGRSRLNS NTQGEMKFEVENLILHKDYSADTLAHHNDIALLKIRSKEGR CAQPSRTIQTICLPSMYNDPQFGTSCEITGFGKENSTDYLY PEQLKMTVVKLISHRECQQPHYYGSEVTTKMLCAADPQWKT DSCQGDSGGPLVCSLQGRMTLTGIVSWGRGCALKDKPGVYT RVSHFLPWIRSHTKEENGLAL (SEQ ID NO: 90) |
| Human ATF | SNELHQVPSNCDCLNGGTCVSYKYFSNIHRCNCPKKFGGQH CEIDKSKTCYEGNGHFYRGKASTDTMGRPCLPWNSATVLQQ TYHAHRSDALQLGLGKHNYCRNPDNRRRPWCYVQVGLKPLV QECMVHDCA (SEQ ID NO: 91) |
| Mouse uPA UniProt: P06869 | MKVWLASLFLCALVVKNSEGGSVLGAPDESNCGCQNGGVCV SYKYFSRIRRCSCPRKFQGEHCEIDASKTCYHGNGDSYRGK ANTDTKGRPCLAWNAPAVLQKPYNAHRPDAISLGLGKHNYC RNPDNQKRPWCYVQIGLRQFVQECMVHDCSLSKKPSSSVDQ QGFQCGQKALRPRFKIVGGEFTEVENQPWFAAIYQKNKGGS PPSFKCGGSLISPCWVASAAHCFIQLPKKENYVVYLGQSKE SSYNPGEMKFEVEQLILHEYYREDSLAYHNDIALLKIRTST GQCAQPSRSIQTICLPPRFTDAPFGSDCEITGFGKESESDY LYPKNLKMSVVKLVSHEQCMQPHYYGSEINYKMLCAADPEW KTDSCKGDSGGPLICNIEGRPTLSGIVSWGRGCAEKNKPGV YTRVSHFLDWIQSHIGEEKGLAF (SEQ ID NO: 93) |
| human cpIL-2: IL-2Ra fusion | SKNFHLRPRDLISNINVIVLELKGSETTFMCEYADETATIV EFLNRWITFSQSIISTLTGGSSSTKKTQLQLEHLLLDLQMI LNGINNYKNPKLTRMLTFKFYMPKKATELKHLQCLEEELKP LEEVLNLAQGSGGGSELCDDDPPEIPHATFKAMAYKEGTML NCECKRGFRRIKSGSLYMLCTGNSSHSSWDNQCQCTSSATR NTTKQVTPQPEEQKERKTTEMQSPMQPVDQASLPGHCREPP PWENEATERIYHFVVGQMVYYQCVQGYRALHRGPAESVCKM THGKTRWTQPQLICTG (SEQ ID NO: 94) |
| human IL-15Ra: cpIL-15 | ITCPPPMSVEHADIWVKSYSLYSRERYICNSGFKRKAGTSS LTECVLNKATNVAHWTTPSLKCIRDGGSELEEKNIKEFLQS FVHIVQMFINGGGSNWVNVISDLKKIEDLIQSMHIDATLYT ESDVHPSCKVTAMKCFLLELQVISLESGDASIHDTVENLII LANNSLSSNGNVTESGCKEC* (SEQ ID NO: 95) |
| cp murine IL-2-IL-2Ra fusion | SSKSFQLEDAENFISNIRVTVVKLKGSDNTFECQFDDESAT VVDFLRRWIAFCQSIISTSPQGGSSSTQQQQQHLEQLLMDL QELLSRMENYRNLKLPRMLTFKFYLPKQATELKDLQCLEDE LGPLRHVLDLTQGSGGGSELCLYDPPEVPNATFKALSYKNG TILNCECKRGFRRLKELVYMRCLGNSWSSNCQCTSNSHDKS RKQVTAQLEHQKEQQTTTDMQKPTQSMHQENLTGHCREPPP WKHEDSKRIYHFVEGQSVHYECIPGYKALQRGPAISICKMK CGKTGWTQPQLTCVD* (SEQ ID NO: 96) |
| Mouse IL-15: 15Ra fusion | TTCPPPVSIEHADIRVKNYSVNSRERYVCNSGFKRKAGTST LIECVINKNTNVAHWTTPSLKCIRDggsELEEKTFTEFLQS FIRIVQMFINgggsNWIDVRYDLEKIESLIQSIHIDTTLYT DSDFHPSCKVTAMNCFLLELQVILHEYSNMTLNETVRNVLY LANSTLSSNKNVAESGCKEC** (SEQ ID NO: 97) |
| Human uPA-ATF: human cpIL-2: IL-2Ra | SNELHQVPSNCDCLNGGTCVSNKYFSNIHWCNCPKKFGGQH CEIDKSKTCYEGNGHFYRGKASTDTMGRPCLPWNSATVLQQ TYHAHRSDALQLGLGKHNYCRNPDNRRRPWCYVQVGLKPLV QECMVHDCAGGSGGGSKNFHLRPRDLISNINVIVLELKGSET TFMCEYADETATIVEFLNRWITFSQSIISTLTGGSSSTKKT QLQLEHLLLDLQMILNGINNYKNPKLTRMLTFKFYMPKKAT ELKHLQCLEEELKPLEEVLNLAQGSGGGSELCDDDPPEIPH ATFKAMAYKEGTMLNCECKRGFRRIKSGSLYMLCTGNSSHS SWDNQCQCTSSATRNTTKQVTPQPEEQKERKTTEMQSPMQP VDQASLPGHCREPPPWENEATERIYHFVVGQMVYYQCVQGY RALHRGPAESVCKMTHGKTRWTQPQLICTG (SEQ ID NO: 98) |
| Human cpIL-2: IL-2Ra: Human uPA-ATF | SKNFHLRPRDLISNINVIVLELKGSETTFMCEYADETATIV EFLNRWITFSQSIISTLTGGSSSTKKTQLQLEHLLLDLQMI LNGINNYKNPKLTRMLTFKFYMPKKATELKHLQCLEEELKP LEEVLNLAQGSGGGSELCDDDPPEIPHATFKAMAYKEGTML |

TABLE 31-continued

Amino Acid Sequences Of Polypeptides Described In Example 6

| Description | Amino Acid Sequence/SEQ ID NO |
|---|---|
| | NCECKRGFRRIKSGSLYMLCTGNSSHSSWDNQCQCTSSATR<br>NTTKQVTPQPEEQKERKTTEMQSPMQPVDQASLPGHCREPP<br>PWENEATERIYHFVVGQMVYYQCVQGYRALHRGPAESVCKM<br>THGKTRWTQPQLICTGGGSGGSNELHQVPSNCDCLNGGTCV<br>SNKYFSNIHWCNCPKKFGGQHCEIDKSKTCYEGNGHFYRGK<br>ASTDTMGRPCLPWNSATVLQQTYHAHRSDALQLGLGKHNYC<br>RNPDNRRRPWCYVQVGLKPLVQECMVHDCA (SEQ ID<br>NO: 99) |
| Human uPA-ATF: human IL-15Ra: cpIL-15 | SNELHQVPSNCDCLNGGTCVSNKYFSNIHWCNCPKKFGGQH<br>CEIDKSKTCYEGNGHFYRGKASTDTMGRPCLPWNSATVLQQ<br>TYHAHRSDALQLGLGKHNYCRNPDNRRRPWCYVQVGLKPLV<br>QECMVHDCAGGSGGITCPPPMSVEHADIWVKSYSLYSRERY<br>ICNSGFKRKAGTSSLTECVLNKATNVAHWTTPSLKCIRDGG<br>SELEEKNIKEFLQSFVHIVQMFINGGGSNWVNVISDLKKIE<br>DLIQSMHIDATLYTESDVHPSCKVTAMKCFLLELQVISLES<br>GDASIHDTVENLIILANNSLSSNGNVTESGCKEC (SEQ<br>ID NO: 100) |
| mouse cpIL-2: IL-2Ra: mouse uPA-ATF | SKSFQLEDAENFISNIRVTVVKLKGSDNTFECQFDDESATV<br>VDFLRRWIAFCQSIISTSPQGGSSSTQQQQQHLEQLLMDLQ<br>ELLSRMENYRNLKLPRMLTF<u>KFYL</u>PKQATELKDLQCLEDEL<br>GPLRHVLDLTQGSGGGSELCLYDPPEVPNATFKALSYKNGT<br>ILNCECKRGF<u>RRLKEL</u>VYMRCLGNSWSSNCQCTSNSHDKSR<br>KQVTAQLEHQKEQQTTTDMQKPTQSMHQENLTGHCREPPPW<br>KHEDSKRIYHFVEGQSVHYECIPGYKALQRGPAISICKMKC<br>GKTGWTQPQLTCVDggsggGSVLGAPDESNCGCQNGGVCVS<br>YKYFSRIRRCSCPRKFQGEHCEIDASKTCYHGNGDSYRGKA<br>NTDTKGRPCLAWNAPAVLQKPYNAHRPDAISLGLGKHNYCR<br>NPDNQKRPWCYVQIGLRQFVQECMVHDC (SEQ ID NO:<br>101) |
| uPA-ATF: mouse IL-15Ra: cpIL-15 | GSVLGAPDESNCGCQNGGVCVSYKYFSRIRRCSCPRKFQGE<br>HCEIDASKTCYHGNGDSYRGKANTDTKGRPCLAWNAPAVLQ<br>KPYNAHRPDAISLGLGKHNYCRNPDNQKRPWCYVQIGLRQF<br>VQECMVHDCGGSGGTTCPPPVSIEHADIRVKNYSVNSRERY<br>VCNSGFKRKAGTSTLIECVINKNTNVAHWTTPSLKCIRDGG<br>SELEEKTFTEFLQSFIRIVQMFINGGGSNWIDVRYDLEKIE<br>SLIQSIHIDTTLYTDSDFHPSCKVTAMNCFLLELQVILHEY<br>SNMTLNETVRNVLYLANSTLSSNKNVAESGCKEC (SEQ<br>ID NO: 102) |
| Human uPA-ATF (control molecule) | SNELHQVPSNCDCLNGGTCVSNKYFSNIHWCNCPKKFGGQH<br>CEIDKSKTCYEGNGHFYRGKASTDTMGRPCLPWNSATVLQQ<br>TYHAHRSDALQLGLGKHNYCRNPDNRRRPWCYVQVGLKPLV<br>QECMVHDCA (SEQ ID NO: 103) |
| Mouse uPA-ATF (control molecule) | GSVLGAPDESNCGCQNGGVCVSYKYFSRIRRCSCPRKFQGE<br>HCEIDASKTCYHGNGDSYRGKANTDTKGRPCLAWNAPAVLQ<br>KPYNAHRPDAISLGLGKHNYCRNPDNQKRPWCYVQIGLRQF<br>VQECMVHDC (SEQ ID NO: 104) |
| Mouse uPA-ATF: mouse cpIL-2: IL-2Ra | GSVLGAPDESNCGCQNGGVCVSYKYFSRIRRCSCPRKFQGE<br>HCEIDASKTCYHGNGDSYRGKANTDTKGRPCLAWNAPAVLQ<br>KPYNAHRPDAISLGLGKHNYCRNPDNQKRPWCYVQIGLRQF<br>VQECMVHDCGGSGGKSFQLEDAENFISNIRVTVVKLKGSD<br>NTFECQFDDESATVVDFLRRWIAFCQSIISTSPQGGSSSTQ<br>QQQQHLEQLLMDLQELLSRMENYRNLKLPRMLTFKFYLPKQ<br>ATELKDLQCLEDELGPLRHVLDLTQGSGGGSELCLYDPPEV<br>PNATFKALSYKNGTILNCECKRGFRRLKELVYMRCLGNSWS<br>SNCQCTSNSHDKSRKQVTAQLEHQKEQQTTTDMQKPTQSMH<br>QENLTGHCREPPPWKHEDSKRIYHFVEGQSVHYECIPGYKA<br>LQRGPAISICKMKCGKTGWTQPQLTCVD (SEQ ID NO:<br>105) |
| human cpIL-2: IL-2Ra: human IgG1 Fc: Human uPA-ATF*<br><br>*Molecule may be modified to reduce ADCC by mutating underlined LL to AA. | SKNFHLRPRDLISNINVIVLELKGSETTFMCEYADETATIV<br>EFLNRWITFSQSIISTLTGGSSSTKKTQLQLEHLLLDLQMI<br>LNGINNYK<u>N</u>PKLTRMLTFKFYMPKKATELKHLQCLEEELKP<br>LEEVLNLAQGSGGGSELCDDDPPEIPHATFKAMAYKEGTML<br>NCECKRGFRRIKSGSLYMLCTGNSSHSSWDNQCQCTSSATR<br>NTTKQVTPQPEEQKERKTTEMQSPMQPVDQASLPGHCREPP<br>PWENEATERIYHFVVGQMVYYQCVQGYRALHRGPAESVCKM<br>THGKTRWTQPQLICTGgggsEPKSSDKTHTCPPCPAPELLG<br>GPSVFLFPPKPKDTLMISRTPEVTCVVVDVSHEDPEVK<u>F</u>NW<br>YVDGVEVHNAKTKPREEQYNSTYRVVSVLTVLHQDWLNGKE<br>YKCKVSNKALPAPIEKTISKAKGQPREPQVYTLPPSREEMT |

TABLE 31-continued

Amino Acid Sequences Of Polypeptides Described In Example 6

| Description | Amino Acid Sequence/SEQ ID NO |
|---|---|
| | KNQVSLTCLVKGFYPSDIAVEWESNGQPENNYKTTPPVLDS<br>DGSFFLYSKLTVDKSRWQQGNVFSCSVMHEALHNHYTQKSL<br>SLSPGKGGSGGGSNELHQVPSNCDCLNGGTCVSNKYFSNIH<br>WCNCPKKFGGQHCEIDKSKTCYEGNGHFYRGKASTDTMGRP<br>CLPWNSATVLQQTYHAHRSDALQLGLGKHNYCRNPDNRRRP<br>WCYVQVGLKPLVQECMVHDCA (SEQ ID NO: 106) |
| Human uPA-ATF:<br>human IgG1 Fc: h cp<br>IL-15<br>Molecule may be<br>modified to reduce<br>ADCC by mutating<br>underlined LL to AA. | SNELHQVPSNCDCLNGGTCVSNKYFSNIHWCNCPKKFGGQH<br>CEIDKSKTCYEGNGHFYRGKASTDTMGRPCLPWNSATVLQQ<br>TYHAHRSDALQLGLGKHNYCRNPDNRRRPWCYVQVGLKPLV<br>QECMVHDCAGGSGGEPKSSDKTHTCPPCPAPE<u>LL</u>GGPSVFL<br>FPPKPKDTLMISRTPEVTCVVVDVSHEDPEVK<u>FN</u>WYVDGVE<br>VHNAKTKPREEQYNSTYRVVSVLTVLHQDWLNGKEYKCKVS<br>NKALPAPIEKTISKAKGQPREPQVYTLPPSREEMTKNQVSL<br>TCLVKGFYPSDIAVEWESNGQPENNYKTTPPVLDSDGSFFL<br>YSKLTVDKSRWQQGNVFSCSVMHEALHNHYTQKSLSLSPGK<br>gsITCPPPMSVEHADIWVKSYSLYSRERYICNSGFKRKAGT<br>SSLTECVLNKATNVAHWTTPSLKCIRDGGSELEEKNIKEFL<br>QSFVHIVQMFINGGGSNWVNVISDLKKIEDLIQSMHIDATL<br>YTESDVHPSCKVTAMKCFLLELQVISLESGDASIHDTVENL<br>IILANNSLSSNGNVTESGCKEC (SEQ ID NO: 107) |
| mouse cpIL-2: IL-<br>2Ra: mouse<br>IgG1: mouse uPA-<br>ATF | SKSFQLEDAENFISNIRVTVVKLKGSDNTFECQFDDESATV<br>VDFLRRWIAFCQSIISTSPQGGSSSTQQQQQHLEQLLMDLQ<br>ELLSRMENYRNLKLPRMLTFKFYLPKQATELKDLQCLEDEL<br>GPLRHVLDLTQGSGGGSELCLYDPPEVPNATFKALSYKNGT<br>ILNCECKRGFRRLKELVYMRCLGNSWSSNCQCTSNSHDKSR<br>KQVTAQLEHQKEQQTTTDMQKPTQSMHQENLTGHCREPPPW<br>KHEDSKRIYHFVEGQSVHYECIPGYKALQRGPAISICKMKC<br>GKTGWTQPQLTCVDgsVPRD<u>S</u>GCKPCICTVPEVSSVFIFPP<br>KPKDVLTITLTPKVTCVVVA<u>I</u>SKDDPEVQFSWFVDDVEVHT<br>AQTQPREEQFNSTFRSVSELPIMHQDWLNGKEFKCRVNSAA<br>FPAPIEKTISKTKGRPKAPQVYTIPPPKEQMAKDKVSLTCM<br>ITDFFPEDITVEWQWNGQPAENYKNTQPIMNTNGSYFVYSK<br>LNVQKSNWEAGNTFTCSVLHEGLHNHHTEKSLSHSPGKggs<br>ggsGSVLGAPDESNCGCQNGGVCVSYKYFSRIRRCSCPRKF<br>QGEHCEIDASKTCYHGNGDSYRGKANTDTKGRPCLAWNAPA<br>VLQKPYNAHRPDAISLGLGKHNYCRNPDNQKRPWCYVQIGL<br>RQFVQECMVHDC (SEQ ID NO: 108) |
| Mouse uPA-<br>ATF: Fc: m cp IL-15 | GSVLGAPDESNCGCQNGGVCVSYKYFSRIRRCSCPRKFQGE<br>HCEIDASKTCYHGNGDSYRGKANTDTKGRPCLAWNAPAVLQ<br>KPYNAHRPDAISLGLGKHNYCRNPDNQKRPWCYVQIGLRQF<br>VQECMVHDCggsggVPRDSGCKPCICTVPEVSSVFIFPPKP<br>KDVLTITLTPKVTCVVVA<u>I</u>SKDDPEVQFSWFVDDVEVHTAQ<br>TQPREEQFNSTFRSVSELPIMHQDWLNGKEFKCRVNSAAFP<br>APIEKTISKTKGRPKAPQVYTIPPPKEQMAKDKVSLTCMIT<br>DFFPEDITVEWQWNGQPAENYKNTQPIMNTNGSYFVYSKLN<br>VQKSNWEAGNTFTCSVLHEGLHNHHTEKSLSHSPGKggsTT<br>CPPPVSIEHADIRVKNYSVNSRERYVCNSGFKRKAGTSTLI<br>ECVINKNTNVAHWTTPSLKCIRDggsELEEKTFTEFLQSFI<br>RIVQMFINgggsNWIDVRYDLEKIESLIQSIHIDTTLYTDS<br>DFHPSCKVTAMNCFLLELQVILHEYSNMTLNETVRNVLYLA<br>NSTLSSNKNVAESGCKEC (SEQ ID NO: 109) |
| human cpIL_-2: IL-2Ra<br>fusion: Human uPA-<br>ATF (N22Y; W30R) | SKNFHLRPRDLISNINVIVLELKGSETTFMCEYADETATIV<br>EFLNRWITFSQSIISTLTGGSSSTKKTQLQLEHLLLDLQMI<br>LNGINNY<u>K</u>NPKLTRMLTFKFYMPKKATELKHLQCLEEELKP<br>LEEVLNLAQGSGGGSELCDDDPPEIPHATFKAMAYKEGTML<br>NCECKRGFRRIKSGSLYMLCTGNSSHSSWDNQCQCTSSATR<br>NTTKQVTPQPEEQKERKTTEMQSPMQPVDQASLPGHCREPP<br>PWENEATERIYHFVVGQMVYYQCVQGYRALHRGPAESVCKM<br>THGKTRWTQPQLICTGGGSGGSNELHQVPSNCDCLNGGTCV<br>SYKYFSNIHRCNCPKKFGGQHCEIDKSKTCYEGNGHFYRGK<br>ASTDTMGRPCLPWNSATVLQQTYHAHRSDALQLGLGKHNYC<br>RNPDNRRRPWCYVQVGLKPLVQECMVHDCA** (SEQ ID<br>NO: 110) |
| human cpIL-2: IL-<br>2Ra-P25- | SKNFHLRPRDLISNINVIVLELKGSETTFMCEYADETATIV<br>EFLNRWITFSQSIISTLTGGSSSTKKTQLQLEHLLLDLQMI<br>LNGINNYKNPKLTRMLTFKFYMPKKATELKHLQCLEEELKP<br>LEEVLNLAQGSGGGSELCDDDPPEIPHATFKAMAYKEGTML<br>NCECKRGFRRIKSGSLYMLCTGNSSHSSWDNQCQCTSSATR |

TABLE 31-continued

Amino Acid Sequences Of Polypeptides Described In Example 6

| Description | Amino Acid Sequence/SEQ ID NO |
|---|---|
| | NTTKQVTPQPEEQKERKTTEMQSPMQPVDQASLPGHCREPP PWENEATERIYHFVVGQMVYYQCVQGYRALHRGPAESVCKM THGKTRWTQPQLICTGGGSGGGGSGGAESTYHHLSLGYMYT LNGGSHHHHHGGSGLNDIFEAQKIEWHE (SEQ ID NO: 111) |
| human cpIL-2: IL-2Ra-ssP25- | SKNFHLRPRDLISNINVIVLELKGSETTFMCEYADETATIV EFLNRWITFSQSIISTLTGGSSSTKKTQLQLEHLLLDLQMI LNGINNYKNPKLTRMLTFKFYMPKKATELKHLQCLEEELKP LEEVLNLAQGSGGGSELCDDDPPEIPHATFKAMAYKEGTML NCECKRGFRRIKSGSLYMLCTGNSSHSSWDNQCQCTSSATR NTTKQVTPQPEEQKERKTTEMQSPMQPVDQASLPGHCREPP PWENEATERIYHFVVGQMVYYQCVQGYRALHRGPAESVCKM THGKTRWTQPQLICTGGGSGGGGSGGNYHYLESSMTALYTL GH (SEQ ID NO: 112) |
| human cpIL-2: IL-2Ra-M25 | SKNFHLRPRDLISNINVIVLELKGSETTFMCEYADETATIV EFLNRWITFSQSIISTLTGGSSSTKKTQLQLEHLLLDLQMI LNGINNYKNPKLTRMLTFKFYMPKKATELKHLQCLEEELKP LEEVLNLAQGSGGGSELCDDDPPEIPHATFKAMAYKEGTML NCECKRGFRRIKSGSLYMLCTGNSSHSSWDNQCQCTSSATR NTTKQVTPQPEEQKERKTTEMQSPMQPVDQASLPGHCREPP PWENEATERIYHFVVGQMVYYQCVQGYRALHRGPAESVCKM THGKTRWTQPQLICTGGGSGGGGSGGPRYQHIGLVAMFRQN TG (SEQ ID NO: 113) |
| human cpIL-2: IL-2Ra-ssM25 | SKNFHLRPRDLISNINVIVLELKGSETTFMCEYADETATIV EFLNRWITFSQSIISTLTGGSSSTKKTQLQLEHLLLDLQMI LNGINNYKNPKLTRMLTFKFYMPKKATELKHLQCLEEELKP LEEVLNLAQGSGGGSELCDDDPPEIPHATFKAMAYKEGTML NCECKRGFRRIKSGSLYMLCTGNSSHSSWDNQCQCTSSATR NTTKQVTPQPEEQKERKTTEMQSPMQPVDQASLPGHCREPP PWENEATERIYHFVVGQMVYYQCVQGYRALHRGPAESVCKM THGKTRWTQPQLICTGGGSGGGGSGGHQIPGAYRGVNQRFT ML (SEQ ID NO: 114) |
| anti-CTLA-4 9d9 Mouse IgG kappa light chain | DIRRADIVMTQTTLSLPVSLGDQASISCRSSQSIVHSNGNT YLEWYLQKPGQSPKLLIYKVSNRFSGVPDRFSGSGSGTDFT LKISRVEAEDLGVYYCFQGSHVPYTFGGGTKLEIKRADAAP TVSIFPPSSEQLTSGGASVVCFLNNFYPKDINVKWKIDGSE RQNGVLNSWTDQDSKDSTYSMSSTLTLTKDEYERHNSYTCE ATHKTSTSPIVKSFNRNEC (SEQ ID NO: 115) |
| 9d9 Mouse IgG2a heavy chain | EAKLQESGPVLVKPGASVKMSCKASGYTFTDYYMNWVKQSH GKSLEWIGVINPYNGDTSYNQKFKGKATLTVDKSSSTAYME LNSLTSEDSAVYYCARYYGSWFAYWGQGTLITVSTAKTTAP SVYPLAPVCGDTTGSSVTLGCLVKGYFPEPVTLTWNSGSLS SGVHTFPAVLQSDLYTLSSSVTVTSSTWPSQSITCNVAHPA SSTKVDKKIEPRGPTIKPCPPCKCPAPNLLGGPSVFIFPPK IKDVLMISLSPIVTCVVVDVSEDDPDVQISWFVNNVEVHTA QTQTHREDYNSTLRVVSALPIQHQDWMSGKEFKCKVNNKDL PAPIERTISKPKGSVRAPQVYVLPPPEEEMTKKQVTLTCMV TDFMPEDIYVEWTNNGKTELNYKNTEPVLDSDGSYFMYSKL RVEKKNWVERNSYSCSVVHEGLHNHHTTKSFSRTPGK** (SEQ ID NO: 116) |
| anti-CTLA-4 9d9 Mouse IgG2a heavy chain: mouse uPA-ATF | EAKLQESGPVLVKPGASVKMSCKASGYTFTDYYMNWVKQSH GKSLEWIGVINPYNGDTSYNQKFKGKATLTVDKSSSTAYME LNSLTSEDSAVYYCARYYGSWFAYWGQGTLITVSTAKTTAP SVYPLAPVCGDTTGSSVTLGCLVKGYFPEPVTLTWNSGSLS SGVHTFPAVLQSDLYTLSSSVTVTSSTWPSQSITCNVAHPA SSTKVDKKIEPRGPTIKPCPPCKCPAPNLLGGPSVFIFPPK IKDVLMISLSPIVTCVVVDVSEDDPDVQISWFVNNVEVHTA QTQTHREDYNSTLRVVSALPIQHQDWMSGKEFKCKVNNKDL PAPIERTISKPKGSVRAPQVYVLPPPEEEMTKKQVTLTCMV TDFMPEDIYVEWTNNGKTELNYKNTEPVLDSDGSYFMYSKL RVEKKNWVERNSYSCSVVHEGLHNHHTTKSFSRTPGKggsg gsGSVLGAPDESNCGCQNGGVCVSYKYFSRIRRCSCPRKFQ GEHCEIDASKTCYHGNGDSYRGKANTDTKGRPCLAWNAPAV LQKPYNAHRPDAISLGLGKHNYCRNPDNQKRPWCYVQIGLR QFVQECMVHDC (SEQ ID NO: 117)** |

TABLE 31-continued

Amino Acid Sequences Of Polypeptides Described In Example 6

| Description | Amino Acid Sequence/SEQ ID NO |
|---|---|
| U.S. Pat. No.: _7858746_B24_light J43; anti-PD-1 J43 light chain | YELTQPPSASVNVGETVKITCSGDQLPKYFADWFHQRSDQT ILQVIYDDNKRPSGIPERISGSSSGTTATLTIRDVRAEDEG DYYCFSGYVDSDSKLYVFGSGTQLTVLGGPKSSPKVTVFPP SPEELRTNKATLVCLVNDFYPGSATVTWKANGATINDGVKT TKPSKQGQNYMTSSYLSLTADQWKSHNRVSCQVTHEGETVE KSLSPAECL** (SEQ ID NO: 118) |
| U.S. Pat. No. 7858746_B2_11 heavy v J43 using GenBank; AAA82733.1 for CH1, 2, 3; anti-PD-1 J43 heavy chain | RLLESGGGLVKPEGSLKLSCVASGFTFSDYFMSWVRQAPGK GLEWVAHIYTKSYNYATYYSGSVKGRFTISRDDSRSMVYLQ MNNLRTEDTATYYCTRDGSGYPSLDFWGQGTQVTVSSATTT apsvyplapacdsttsttdtvtlgclvkgyfpepvtvswns galtsgvhtfpsvlhsglyslsssvtvpsstwpkqpitcnv ahpasstkvdkkieprtdtdtcpnppdpcptcptpdllggp svfifppkpkdvlmisltpkitcvvvdvseeepdvqfnwyv nnvedktaqtetrqrqynstyrvvsvlpikhqdwmsgkvfk ckvnnnalpspiektiskprgqvrvpqiytfpppieqtvkk dvsvtclvtgflpqdihvewesngqpqpeqnykntqpvlds dgsyflysklnvpksrwdqgdsftcsvihealhnhhmtkti srslgn** (SEQ ID NO: 119) |
| anti-PD-1 J43 heavy chain: mouse ATF | RLLESGGGLVKPEGSLKLSCVASGFTFSDYFMSWVRQAPGK GLEWVAHIYTKSYNYATYYSGSVKGRFTISRDDSRSMVYLQ MNNLRTEDTATYYCTRDGSGYPSLDFWGQGTQVTVSSATTT apsvyplapacdsttsttdtvtlgclvkgyfpepvtvswns galtsgvhtfpsvlhsglyslsssvtvpsstwpkqpitcnv ahpasstkvdkkieprtdtdtcpnppdpcptcptpdllggp svfifppkpkdvlmisltpkitcvvvdvseeepdvqfnwyv nnvedktaqtetrqrqynstyrvvsvlpikhqdwmsgkvfk ckvnnnalpspiektiskprgqvrvpqiytfpppieqtvkk dvsvtclvtgflpqdihvewesngqpqpeqnykntqpvlds dgsyflysklnvpksrwdqgdsftcsvihealhnhhmtkti srslgnggsggsGSVLGAPDESNCGCQNGGVCVSYKYFSRI RRCSCPRKFQGEHCEIDASKTCYHGNGDSYRGKANTDTKGR PCLAWNAPAVLQKPYNAHRPDAISLGLGKHNYCRNPDNQKR PWCYVQIGLRQFVQECMVHDC (SEQ ID NO: 120) |
| mouse ATF: anti-PD-1 J43 heavy chain | GSVLGAPDESNCGCQNGGVCVSYKYFSRIRRCSCPRKFQGE HCEIDASKTCYHGNGDSYRGKANTDTKGRPCLAWNAPAVLQ KPYNAHRPDAISLGLGKHNYCRNPDNQKRPWCYVQIGLRQF VQECMVHDCggsggRLLESGGGLVKPEGSLKLSCVASGFTF SDYFMSWVRQAPGKGLEWVAHIYTKSYNYATYYSGSVKGRF TISRDDSRSMVYLQMNNLRTEDTATYYCTRDGSGYPSLDFW GQGTQVTVSSATTTapsvyplapacdsttsttdtvtlgclv kgyfpepvtvswnsgaltsgvhtfpsvlhsglyslsssvtv psstwpkqpitcnvahpasstkvdkkieprtdtdtcpnppd pcptcptpdllggpsvfifppkpkdvlmisltpkitcvvvd vseeepdvqfnwyvnnvedktaqtetrqrqynstyrvvsvl pikhqdwmsgkvfckvnnnalpspiektiskprgqvrvpq iytfpppieqtvkkdvsvtclvtgflpqdihvewesngqpq peqnykntqpvldsdgsyflysklnvpksrwdqgdsftcsv ihealhnhhmtktisrslgn (SEQ ID NO: 121) |
| Parent human PD-1 (UniProt: Q15116) extracellular domain | MQIPQAPWPVVWAVLQLGWRPGWFLDSPDRPW*NPPTFSPAL LVVTEGDNTFTCSFSNTSESFVLNWYRMSPS*NQTDKLAAFPED RSQPGQDCRFRVTQLPNGRDFHMSVVRARRNDSGTYLCGAIS LAPKAQIKESLRA*ELRVTERRAEVPTAHPSPRPAGQFQTLV VGVVGGLLGSLVLLVWVLAVICSRAARGTIGARRTGQPLKE DPSAVPVFSVDYGELDFQWREKTPEPPVPCVPEQTEYATIV FPSGMGTSSPARRGSADGPRSAQPLRPEDGHCSWPL (SEQ ID NO: 122) |
| human uPA-ATF:5AA linker human PD-1 | SNELHQVPSNCDCLNGGTCVSYKYFSNIHRCNCPKKFGGQH CEIDKSKTCYEGNGHFYRGKASTDTMGRPCLPWNSATVLQQ TYHAHRSDALQLGLGKHNYCRNPDNRRRPWCYVQVGLKPLV QECMVHDCAGGSGGPGWFLDSPDRPW*NPPTFSPALLVVTEG DNATFTCSFSNTSESFVLNWYRMSPSNQTDKLAAFPEDRSQ PGQDCRFRVTQLPNGRDFHMSWRARRNDSGTYLCGAISLAP KAQIKESLRAELRVTERRAEVPTAHPSPRPAGQFQTLV* (SEQ ID NO: 123) |
| huPA-ATF (N22Y, W30R): 10AA linker: hPD-1: | SNELHQVPSNCDCLNGGTCVSYKYFSNIHRCNCPKKFGGQH CEIDKSKTCYEGNGHFYRGKASTDTMGRPCLPWNSATVLQQ TYHAHRSDALQLGLGKHNYCRNPDNRRRPWCYVQVGLKPLV QECMVHDCAGGSGGGSGGPGWFLDSPDRPW*NPPTFSPALL VVTEGDNATFTCSFSNTSESFVLNWYRMSPSNQTDKLAAFP* |

TABLE 31-continued

Amino Acid Sequences Of Polypeptides Described In Example 6

| Description | Amino Acid Sequence/SEQ ID NO |
|---|---|
| | *EDRSQPGQDCRFRVTQLPNGRDFHMSWRARRNDSGTYLCGA*<br>*ISLAPKAQIKESLRAELRVTERRAEVPTAHPSPSPRPAGQF*<br>*QTLV* (SEQ ID NO: 124) |
| hPD-1: 5AA linker: huPA-ATF (N22Y, W30R) | PGWYWSPDRPW*NPPTFSPALLWTEGDNATFTCSFSNTSESF*<br>*VLNWYRMSPSNQTDKLAAFPEDRSQPGQDCRFRVTQLPNGR*<br>*DFHMSVVRARRNDSGTYLCGAISLAPKAQIKESLRAELRVT*<br>*ERRAEVPTAHPSPSPRPAGQFQTLV*GGSGGSNELHQVPSNC<br>DCLNGGTCVSYKYFSNIHRCNCPKKFGGQHCEIDKSKTCYE<br>GNGHFYRGKASTDTMGRPCLPWNSATVLQQTYHAHRSDALQ<br>LGLGKHNYCRNPDNRRRPWCYVQVGLKPLVQECMVHDCA<br>(SEQ ID NO: 125) |
| hPD-1: 10AA linker: huPA-ATF (N22Y, W30R): | PSPRPAGQFQTLVGGSGGGSGGSNELHQVPSNCDCLNGGT<br>CVSNKYFSNIHWCNCPKKFGGQHCEIDKSKTCYEGNGHFYR<br>GKASTDTMGRPCLPWNSATVLQQTYHAHRSDALQLGLGKHN<br>YCRNPDNRRRPWCYVQVGLKPLVQECMVHDCA (SEQ ID NO: 126) |
| mouse ATF: mouse IL-2 | GSVLGAPDESNCGCQNGGVCVSYKYFSRIRRCSCPRKFQGE<br>HCEIDASKTCYHGNGDSYRGKANTDTKGRPCLAWNAPAVLQ<br>KPYNAHRPDAISLGLGKHNYCRNPDNQKRPWCYVQIGLRQF<br>VQECMVHDCggsggAPTSSSTSSSTAEAQQQQQQQQQQQH<br>LEQLLMDLQELLSRMENYRNLKLPRMLTFKFYLPKQATELK<br>DLQCLEDELGPLRHVLDLTQSKSFQLEDAENFISNIRVTVV<br>KLKGSDNTFECQFDDESATVVDFLRRWIAFCQSIISTSPQ<br>(SEQ ID NO: 127) |
| mouse ATF: mouse IL-15 | GSVLGAPDESNCGCQNGGVCVSYKYFSRIRRCSCPRKFQGE<br>HCEIDASKTCYHGNGDSYRGKANTDTKGRPCLAWNAPAVLQ<br>KPYNAHRPDAISLGLGKHNYCRNPDNQKRPWCYVQIGLRQF<br>VQECMVHDCggsggNWIDVRYDLEKIESLIQSIHIDTTLYT<br>DSDFHPSCKVTAMNCFLLELQVILHEYSNMTLNETVRNVLY<br>LANSTLSSNKNVAESGCKECEELEEKTFTEFLQSFIRIVQM<br>FINTS (SEQ ID NO: 128) |
| Linked 4-1BBL Trimer with GSG linkers between monomers | REGPELSPDDPAGLLDLRQGMFAQLVAQNVLLIDGPLSWYS<br>DPGLAGVSLTGGLSYKEDTKELVVAKAGVYYVFFQLELRRV<br>VAGEGSGSVSLALHLQPLRSAAGAAALALTVDLPPASSEAR<br>NSAFGFQGRLLHLSAGQRLGVHLHTEARARHAWQLTQGATV<br>LGLFRVTPEIPAGLPSPRSEGSGREGPELSPDDPAGLLDLR<br>QGMFAQLVAQNVLLIDGPLSWYSDPGLAGVSLTGGLSYKED<br>TKELVVAKAGVYYVFFQLELRRVVAGEGSGSVSLALHLQPL<br>RSAAGAAALALTVDLPPASSEARNSAFGFQGRLLHLSAGQR<br>LGVHLHTEARARHAWQLTQGATVLGLFRVTPEIPAGLPSPR<br>SEGSGREGPELSPDDPAGLLDLRQGMFAQLVAQNVLLIDGP<br>LSWYSDPGLAGVSLTGGLSYKEDTKELVVAKAGVYYVFFQL<br>ELRRVVAGEGSGSVSLALHLQPLRSAAGAAALALTVDLPPA<br>SSEARNSAFGFQGRLLHLSAGQRLGVHLHTEARARHAWQLT<br>QGATVLGLFRVTPEIPAGLPSPRSE(SEQ ID NO: 129) |
| Linked 4-1BBL trimer with GSG linker between monomers | REGPELSPDDPAGLLDLRQGMFAQLVAQNVLLIDGPLSWYS<br>DPGLAGVSLTGGLSYKEDTKELVVAKAGVYYVFFQLELRRV<br>VAGEGSGSVSLALHLQPLRSAAGAAALALTVDLPPASSEAR<br>NSAFGFQGRLLHLSAGQRLGVHLHTEARARHAWQLTQGATV<br>LGLFRVTPEIPAGLPSPRSEGSGREGPELSPDDPAGLLDLR<br>QGMFAQLVAQNVLLIDGPLSWYSDPGLAGVSLTGGLSYKED<br>TKELVVAKAGVYYVFFQLELRRVVAGEGSGSVSLALHLQPL<br>RSAAGAAALALTVDLPPASSEARNSAFGFQGRLLHLSAGQR<br>LGVHLHTEARARHAWQLTQGATVLGLFRVTPEIPAGLPSPR<br>SEGSGREGPELSPDDPAGLLDLRQGMFAQLVAQNVLLIDGP<br>LSWYSDPGLAGVSLTGGLSYKEDTKELVVAKAGVYYVFFQL<br>ELRRVVAGEGSGSVSLALHLQPLRSAAGAAALALTVDLPPA<br>SSEARNSAFGFQGRLLHLSAGQRLGVHLHTEARARHAWQLT<br>QGATVLGLFRVTPEIPAGLPSPRSE (SEQ ID NO: 130) |
| uPA-ATF - 5 Linker - Linked 4-1BBL Trimer | SNELHQVPSNCDCLNGGTCVSNKYFSNIHWCNCPKKFGGQH<br>CEIDKSKTCYEGNGHFYRGKASTDTMGRPCLPWNSATVLQQ<br>TYHAHRSDALQLGLGKHNYCRNPDNRRRPWCYVQVGLKPLV<br>QECMVHDCAGGSGGREGPELSPDDPAGLLDLRQGMFAQLVA<br>QNVLLIDGPLSWYSDPGLAGVSLTGGLSYKEDTKELVVAKA<br>GVYYVFFQLELRRVVAGEGSGSVSLALHLQPLRSAAGAAAL<br>ALTVDLPPASSEARNSAFGFQGRLLHLSAGQRLGVHLHTEA<br>RARHAWQLTQGATVLGLFRVTPEIPAGLPSPRSEGSGREGP<br>ELSPDDPAGLLDLRQGMFAQLVAQNVLLIDGPLSWYSDPGL |

TABLE 31-continued

Amino Acid Sequences Of Polypeptides Described In Example 6

| Description | Amino Acid Sequence/SEQ ID NO |
|---|---|
| | AGVSLTGGLSYKEDTKELVVAKAGVYYVFFQLELRRVVAGE<br>GSGSVSLALHLQPLRSAAGAAALALTVDLPPASSEARNSAF<br>GFQGRLLHLSAGQRLGVHLHTEARARHAWQLTQGATVLGLF<br>RVTPEIPAGLPSPRSEGSGREGPELSPDDPAGLLDLRQGMF<br>AQLVAQNVLLIDGPLSWYSDPGLAGVSLTGGLSYKEDTKEL<br>VVAKAGVYYVFFQLELRRVVAGEGSGSVSLALHLQPLRSAA<br>GAAALALTVDLPPASSEARNSAFGFQGRLLHLSAGQRLGVH<br>LHTEARARHAWQLTQGATVLGLFRVTPEIPAGLPSPRSE<br>(SEQ ID NO: 131) |
| Linked 4-1BBL<br>Trimer - 5 Linker -<br>uPA-ATF | REGPELSPDDPAGLLDLRQGMFAQLVAQNVLLIDGPLSWYS<br>DPGLAGVSLTGGLSYKEDTKELVVAKAGVYYVFFQLELRRV<br>VAGEGSGSVSLALHLQPLRSAAGAAALALTVDLPPASSEAR<br>NSAFGFQGRLLHLSAGQRLGVHLHTEARARHAWQLTQGATV<br>LGLFRVTPEIPAGLPSPRSEGSGREGPELSPDDPAGLLDLR<br>QGMFAQLVAQNVLLIDGPLSWYSDPGLAGVSLTGGLSYKED<br>TKELVVAKAGVYYVFFQLELRRVVAGEGSGSVSLALHLQPL<br>RSAAGAAALALTVDLPPASSEARNSAFGFQGRLLHLSAGQR<br>LGVHLHTEARARHAWQLTQGATVLGLFRVTPEIPAGLPSPR<br>SEGSGREGPELSPDDPAGLLDLRQGMFAQLVAQNVLLIDGP<br>LSWYSDPGLAGVSLTGGLSYKEDTKELVVAKAGVYYVFFQL<br>ELRRVVAGEGSGSVSLALHLQPLRSAAGAAALALTVDLPPA<br>SSEARNSAFGFQGRLLHLSAGQRLGVHLHTEARARHAWQLT<br>QGATVLGLFRVTPEIPAGLPSPRSEGGSGGSNELHQVPSNC<br>DCLNGGTCVSNKYFSNIHWCNCPKKFGGQHCEIDKSKTCYE<br>GNGHFYRGKASTDTMGRPCLPWNSATVLQQTYHAHRSDALQ<br>LGLGKHNYCRNPDNRRRPWCYVQVGLKPLVQECMVHDCA<br>(SEQ ID NO: 132) |
| 4-1BB CL: CH1 Fc<br>fusion (Uniprot: 4-<br>1BB (Q07011\|24-<br>186)): 15AA linker:<br>uPA | LQDPCSNCPAGTFCDNNRNQICSPCPPNSFSSAGGQRTCDI<br>CRQCKGVFRTRKECSSTSNAECDCTPGFHCLGAGCSMCEQD<br>CKQGQELTKKGCKDCCFGTFNDQKRGICRPWTNCSLDGKSV<br>LVNGTKERDVVCGPSPADLSPGASSVTPPAPAREPGHSPQG<br>GGGSGGGGSRTVAAPSVFIFPPSDEQLKSGTASVVCLLNNF<br>YPREAKVQWKVDNALQSGNSQESVTEQDSKDSTYSLSSTLT<br>LSKADYEKHKVYACEVTHQGLSSPVTKSFNRGECGGGGSGG<br>GGSGGGGSGGGGSASTKGPSVFPLAPSSKSTSGGTAALGCL<br>VKDYFPEPVTVSWNSGALTSGVHTFPAVLQSSGLYSLSSWT<br>VPSSSLGTQTYICNVNHKPSNTKVDKRVEPKSCDKTHTCPP<br>CPAPELLGGPSVFLFPPKPKDTLMISRTPEVTCVVVDVSHE<br>DPEVKFNWYVDGVEVHNAKTKPREEQYNSTYRVVSVLTVLH<br>QDWLNGKEYKCKVSNKALPAPIEKTISKAKGQPREPQVYTL<br>PPSREEMTKNQVSLTCLVKGFYPSDIAVEWESNGQPENNYK<br>TTPPVLDSDGSFFLYSKLTVDKSRWQQGNVFSCSVMHEALH<br>NHYTQKSLSLSPGKGGSGGGGSGGGSGGSNELHQVPSNCD<br>CLNGGTCVSNKYFSNIHWCNCPKKFGGQHCEIDKSKTCYEG<br>NGHFYRGKASTDTMGRPCLPWNSATVLQQTYHAHRSDALQL<br>GLGKHNYCRNPDNRRRPWCYVQVGLKPLVQECMVHDCA<br>(SEQ ID NO: 133) |
| OX40 CL: CH1 Fc<br>fusion (OX40<br>Uniprot: P43489\|29-<br>214)): 15 AA linker<br>(Variable length<br>linker): uPA (with<br>or without point<br>mutants for mouse<br>uPAR binding) | LHCVGDTYPSNDRCCHECRPGNGMVSRCSRSQNTVCRPCGP<br>GFYNDVVSSKPCKPCTWCNLRSGSERKQLCTATQDTVCRCR<br>AGTQPLDSYKPGVDCAPCPPGHFSPGDNQACKPWTNCTLAG<br>KHTLQPASNSSDAICEDRDPPATQPQETQGPPARPITVQPT<br>EAWPRTSQGPSTRPVEVPGGRAGGGGSGGGGSRTVAAPSVF<br>IFPPSDEQLKSGTASVVCLLNNFYPREAKVQWKVDNALQSG<br>NSQESVTEQDSKDSTYSLSSTLTLSKADYEKHKVYACEVTH<br>QGLSSPVTKSFNRGECGGGGSGGGGSGGGGSGGGGSASTKG<br>PSVFPLAPSSKSTSGGTAALGCLVKDYFPEPVTVSWNSGAL<br>TSGVHTFPAVLQSSGLYSLSSVVTVPSSSLGTQTYICNVNH<br>KPSNTKVDKRVEPKSCDKTHTCPPCPAPELLGGPSVFLFPP<br>KPKDTLMISRTPEVTCVVVDVSHEDPEVKFNWYVDGVEVHN<br>AKTKPREEQYNSTYRVVSVLTVLHQDWLNGKEYKCKVSNKA<br>LPAPIEKTISKAKGQPREPQVYTLPPSREEMTKNQVSLTCL<br>VKGFYPSDIAVEWESNGQPENNYKTTPPVLDSDGSFFLYSK<br>LTVDKSRWQQGNVFSCSVMHEALHNHYTQKSLSLSPGKGGS<br>GGGGSGGGSGGSNELHQVPSNCDCLNGGTCVSNKYFSNIH<br>WCNCPKKFGGQHCEIDKSKTCYEGNGHFYRGKASTDTMGRP<br>CLPWNSATVLQQTYHAHRSDALQLGLGKHN (SEQ ID<br>NO: 134) |

TABLE 31-continued

Amino Acid Sequences Of Polypeptides Described In Example 6

| Description | Amino Acid Sequence/SEQ ID NO |
|---|---|
| GITR CL: CH1 Fc fusion (GITR (Uniprot: Q9Y5U5\|26-162)): 15 AA linker: human uPA | QRPTGGPGCGPGRLLLGTGTDARCCRVHTTRCCRDYPGEEC CSEWDCMCVQPEFHCGDPCCTTCRHHPCPPGQGVQSQGKFS FGFQCIDCASGTFSGGHEGHCKPWTDCTQFGFLTVFPGNKT HNAVCVPGSPPAEPGGGGSGGGGSRTVAAPSVFIFPPSDEQ LKSGTASVVCLLNNFYPREAKVQWKVDNALQSGNSQESVTE QDSKDSTYSLSSTLTLSKADYEKHKVYACEVTHQGLSSPVT KSFNRGECGGGGSGGGGSGGGGSGGGGSASTKGPSVFPLAP SSKSTSGGTAALGCLVKDYFPEPVTVSWNSGALTSGVHTFP AVLQSSGLYSLSSVVTVPSSSLGTQTYICNVNHKPSNTKVD KRVEPKSCDKTHTCPPCPAPELLGGPSVFLFPPKPKDTLMI SRTPEVTCVVVDVSHEDPEVKFNWYVDGVEVHNAKTKPREE QYNSTYRVVSVLTVLHQDWLNGKEYKCKVSNKALPAPIEKT ISKAKGQPREPQVYTLPPSREEMTKNQVSLTCLVKGFYPSD IAVEWESNGQPENNYKTTPPVLDSDGSFFLYSKLTVDKSRW QQGNVFSCSVMHEALHNHYTQKSLSLSPGKGGSGGGGGSGG GSGGGSNELHQVPSNCDCLNGGTCVSNKYFSNIHWCNCPKKF GGQHCEIDKSKTCYEGNGHFYRGKASTDTMGRPCLPWNSAT VLQQTYHAHRSDALQLGLGKHN (SEQ ID NO: 135) |
| ScIL-10_scV1Vh1Fc_uPA-ATF - 5 aa linker (variable linker length) - uPA-ATF | SPGQGTQSENSCTHFPGNLPNMLRDLRDAFSRVKTFFQMKD QLDNLLLKESLLEDFKGYLGCQALSEMIQFYLEEVMPQAEN QDPDIKAHVNSLGENLKTLRLRLRRCHRFLPCENKSKAVEQ VKNAFNKLQEKGIYKAMSEFDIFINYIEAYMTMKIRNGGGS PGQGTQSENSCTHFPGNLPNMLRDLRDAFSRVKTFFQMKDQ LDNLLLKESLLEDFKGYLGCQALSEMIQFYLEEVMPQAENQ DPDIKAHVNSLGENLKTLRLRLRRCHRFLPCENKSKAVEQV KNAFNKLQEKGIYKAMSEFDIFINYIEAYMTMKIRNGGGGS GGGGSRTVAAPSVFIFPPSDEQLKSGTASVVCLLNNFYPRE AKVQWKVDNALQSGNSQESVTEQDSKDSTYSLSSTLTLSKA DYEKHKVYACEVTHQGLSSPVTKSFNRGECGGGGSGGGGSG GGGSGGGGSASTKGPSVFPLAPSSKSTSGGTAALGCLVKDY FPEPVTVSWNSGALTSGVHTFPAVLQSSGLYSLSSVVTVPS SSLGTQTYICNVNHKPSNTKVDKRVEPKSCDKTHTCPPCPA PELLGGPSVFLFPPKPKDTLMISRTPEVTCVVVDVSHEDPE VKFNWYVDGVEVHNAKTKPREEQYNSTYRVVSVLTVLHQDW LNGKEYKCKVSNKALPAPIEKTISKAKGQPREPQVYTLPPS REEMTKNQVSLTCLVKGFYPSDIAVEWESNGQPENNYKTTP PVLDSDGSFFLYSKLTVDKSRWQQGNVFSCSVMHEALHNHY TQKSLSLSPGKGGSGGSNELHQVPSNCDCLNGGTCVSNKYF SNIHWCNCPKKFGGQHCEIDKSKTCYEGNGHFYRGKASTDT MGRPCLPWNSATVLQQTYHAHRSDALQLGLGKHNYCRNPDN RRRPWCYVQVGLKPLVQECMVHDCA (SEQ ID NO: 136) |
| scIL-10_uPA-ATF (variable length linker)-UPA | SPGQGTQSENSCTHFPGNLPNMLRDLRDAFSRVKTFFQMKD QLDNLLLKESLLEDFKGYLGCQALSEMIQFYLEEVMPQAEN QDPDIKAHVNSLGENLKTLRLRLRRCHRFLPCENKSKAVEQ VKNAFNKLQEKGIYKAMSEFDIFINYIEAYMTMKIRNGGGS PGQGTQSENSCTHFPGNLPNMLRDLRDAFSRVKTFFQMKDQ LDNLLLKESLLEDFKGYLGCQALSEMIQFYLEEVMPQAENQ DPDIKAHVNSLGENLKTLRLRLRRCHRFLPCENKSKAVEQV KNAFNKLQEKGIYKAMSEFDIFINYIEAYMTMKIRNGGSGG GGSGGSNELHQVPSNCDCLNGGTCVSNKYFSNIHWCNCPKK FGGQHCEIDKSKTCYEGNGHFYRGKASTDTMGRPCLPWNSA TVLQQTYHAHRSDALQLGLGKHNYCRNPDNRRRPWCYVQVG LKPLVQECMVHDCA (SEQ ID NO: 137) |
| GM-CSF monomer-huPA-ATF | APARSPSPSTQPWEHVNAIQEARRLLNLSRDTAAEMNETVE VISEMFDLQEPTCLQTRLELYKQGLRGSLTKLKGPLTMMAS HYKQHCPPTPETSCATQIITFESFKENLKDFLLVIPFDCWE PVQEGGSGGSNELHQVPSNCDCLNGGTCVSNKYFSNIHWCN CPKKFGGQHCEIDKSKTCYEGNGHFYRGKASTDTMGRPCLP WNSATVLQQTYHAHRSDALQLGLGKHNYCRNPDNRRRPWCY VQVGLKPLVQECMVHDCA (SEQ ID NO: 138) |
| IL-12 subunit alpha p35 UniProt: P29459 | RNLPVATPDPGMFPCLHHSQNLLRAVSNMLQKARQTLEFYP CTSEEIDHEDITKDKTSTVEACLPLELTKNESCLNSRETSF ITNGSCLASRKTSFMMALCLSSIYEDLKMYQVEFKTMNAKL LMDPKRQIFLDQNMLAVIDELMQALNFNSETVPQKSSLEEP DFYKTKIKLCILLHAFRIRAVTIDRVMSYLNAS (SEQ ID NO: 139) |

TABLE 31-continued

Amino Acid Sequences Of Polypeptides Described In Example 6

| Description | Amino Acid Sequence/SEQ ID NO |
|---|---|
| IL-12 subunit beta p40 UniProt: P29460 | IWELKKDVYVVELDWYPDAPGEMVVLTCDTPEEDGITWTLD QSSEVLGSGKTLTIQVKEFGDAGQYTCHKGGEVLSHSLLLL HKKEDGIWSTDILKDQKEPKNKTFLRCEAKNYSGRFTCWWL TTISTDLTFSVKSSRGSSDPQGVTCGAATLSAERVRGDNKE YEYSVECQEDSACPAAEESLPIEVMVDAVHKLKYENYTSSF FIRDIIKPDPPKNLQLKPLKNSRQVEVSWEYPDTWSTPHSY FSLTFCVQVQGKSKREKKDRVFTDKTSATVICRKNASISVR AQDRYYSSSWSEWASVPCS (SEQ ID NO: 140) |
| P40: 10 AA linker (variable linker length up to 30-40 GlySer): P35: uPA | IWELKKDVYVVELDWYPDAPGEMVVLTCDTPEEDGITWTLD QSSEVLGSGKTLTIQVKEFGDAGQYTCHKGGEVLSHSLLLL HKKEDGIWSTDILKDQKEPKNKTFLRCEAKNYSGRFTCWWL TTISTDLTFSVKSSRGSSDPQGVTCGAATLSAERVRGDNKE YEYSVECQEDSACPAAEESLPIEVMVDAVHKLKYENYTSSF FIRDIIKPDPPKNLQLKPLKNSRQVEVSWEYPDTWSTPHSY FSLTFCVQVQGKSKREKKDRVFTDKTSATVICRKNASISVR AQDRYYSSSWSEWASVPCSGGSGGGGSGGRNLPVATPDPGM FPCLHHSQNLLRAVSNMLQKARQTLEFYPCTSEEIDHEDIT KDKTSTVEACLPLELTKNESCLNSRETSFITNGSCLASRKT SFMMALCLSSIYEDLKMYQVEFKTMNAKLLMDPKRQIFLDQ NMLAVIDELMQALNFNSETVPQKSSLEEPDFYKTKIKLCIL LHAFRIRAVTIDRVMSYLNASGGGSGGGSGGGSSNELHQVP SNCDCLNGGTCVSNKYFSNIHWCNCPKKFGGQHCEIDKSKT CYEGNGHFYRGKASTDTMGRPCLPWNSATVLQQTYHAHRSD ALQLGLGKHNYCRNPDNRRRPWCYVQVGLKPLVQECMVHDC A (SEQ ID NO: 141) |
| huPA-ATF: p40 A preferred mutation is the underlined cysteine to serine (C199S) | SNELHQVPSNCDCLNGGTCVSNKYFSNIHWCNCPKKFGGQH CEIDKSKTCYEGNGHFYRGKASTDTMGRPCLPWNSATVLQQ TYHAHRSDALQLGLGKHNYCRNPDNRRRPWCYVQVGLKPLV QECMVHDCAGGSGGGGSGGIWELKKDVYVVELDWYPDAPGE MVVLTCDTPEEDGITWTLDQSSEVLGSGKTLTIQVKEFGDA GQYTCHKGGEVLSHSLLLLHKKEDGIWSTDILKDQKEPKNK TFLRCEAKNYSGRFTCWWLTTISTDLTFSVKSSRGSSDPQG VTCGAATLSAERVRGDNKEYEYSVECQEDSA<u>C</u>PAAEESLPI EVMVDAVHKLKYENYTSSFFIRDIIKPDPPKNLQLKPLKNS RQVEVSWEYPDTWSTPHSYFSLTFCVQVQGKSKREKKDRVF TDKTSATVICRKNASISVRAQDRYYSSSWSEWASVPCS (SEQ ID NO: 142) |
| P35: huPA-ATF A preferred mutation is the underlined cysteine to serine (C97S) | RNLPVATPDPGMFPCLHHSQNLLRAVSNMLQKARQTLEFYP CTEEIDHEDITKDKTSTVEACLPLELTKNES<u>C</u>LNSRETSFI TNGSCLASRKTSFMMALCLSSIYEDLKMYQV<u>E</u>FKTMNAKLL MDPKRQIFLDQNMLAVIDELMQALNFNSETVPQKSSLEEPD FYKTKIKLCILLHAFRIRAVTIDRVMSYLNASGGGSGGGSG GGSSNELHQVPSNCDCLNGGTCVSNKYFSNIHWCNCPKKFG GQHCEIDKSKTCYEGNGHFYRGKASTDTMGRPCLPWNSATV LQQTYHAHRSDALQLGLGKHNYCRNPDNRRRPWCYVQVGLK PLVQECMVHDCA (SEQ ID NO: 143) |
| > huPA-ATF: P35: huPA-ATF: A preferred mutation is the underlined cysteine to serine (C97S) | SNELHQVPSNCDCLNGGTCVSNKYFSNIHWCNCPKKFGGQH CEIDKSKTCYEGNGHFYRGKASTDTMGRPCLPWNSATVLQQ TYHAHRSDALQLGLGKHNYCRNPDNRRRPWCYVQVGLKPLV QECMVHDCAGGSGGGGSGGRNLPVATPDPGMFPCLHHSQNL LRAVSNMLQKARQTLEFYPCTSEEIDHEDITKDKTSTVEAC LPLELTKNES<u>C</u>LNSRETSFITNGSCLASRKTSFMMALCLSS IYEDLKMYQV<u>E</u>FKTMNAKLLMDPKRQIFLDQNMLAVIDELM QALNFNSETVPQKSSLEEPDFYKTKIKLCILLHAFRIRAVT IDRVMSYLNASGGGSGGGSGGGSSNELHQVPSNCDCLNGGT CVSNKYFSNIHWCNCPKKFGGQHCEIDKSKTCYEGNGHFYR GKASTDTMGRPCLPWNSATVLQQTYHAHRSDALQLGLGKHN YCRNPDNRRRPWCYVQVGLKPLVQECMVHDCAGGSGGHHHH HHGGSGLNDIFEAQKIEWHE (SEQ ID NO: 144) |
| HSA: p40: uPA A exemplary mutation is the underlined cysteine to serine (C199S) | RGVFRRDAHKSEVAHRFKDLGEENFKALVLIAFAQYLQQCP FEDHVKLVNEVTEFAKTCVADESAENCDKSLHTLFGDKLCT VATLRETYGEMADCCAKQEPERNECFLQHKDDNPNLPRLVR PEVDVMCTAFHDNEETFLKKYLYEIARRHPYFYAPELLFFA KRYKAAFTECCQAADKAACLLPKLDELRDEGKASSAKQGLK CASLQKFGERAFKAWAVARLSQRFPKAEFAEVSKLVTDLTK VHTECCHGDLLECADDRADLAKYICENQDSISSKLKECCEK PLLEKSHCIAEVENDEMPADLPSLAADFVGSKDVCKNYAEA KDVFLGMFLYEYARRHPDYSVVLLLRLAKTYETTLEKCCAA ADPHECYAKVFDEFKPLVEEPQNLIKQNCELFEQLGEYKFQ NALLVRYTKKVPQVSTPTLVEVSRNLGKVGSKCCKHPEAKR |

TABLE 31-continued

Amino Acid Sequences Of Polypeptides Described In Example 6

| Description | Amino Acid Sequence/SEQ ID NO |
|---|---|
| | MPCAEDCLSVFLNQLCVLHEKTPVSDRVTKCCTESLVNGRP<br>CFSALEVDETYVPKEFNAETFTFHADICTLSEKERQIKKQT<br>ALVELVKHKPKATKEQLKAVMDDFAAFVEKCCKADDKETCF<br>AEEGKKLVAASQAALGLGGSGGGGSGGIWELKKDVYVVELD<br>WYPDAPGEMVVLTCDTPEEDGITWTLDQSSEVLGSGKTLTI<br>QVKEFGDAGQYTCHKGGEVLSHSLLLLHKKEDGIWSTDILK<br>DQKEPKNKTFLRCEAKNYSGRFTCWWLTTISTDLTFSVKSS<br>RGSSDPQGVTCGAATLSAERVRGDNKEYEYSVECQEDSACP<br>AAEESLPIEVMVDAVHKLKYENYTSSFFIRDIIKPDPPKNL<br>QLKPLKNSRQVEVSWEYPDTWSTPHSYFSLTFCVQVQGKSK<br>REKKDRVFTDKTSATVICRKNASISVRAQDRYYSSSWSEWA<br>SVPCSGGSGGGSGGSNELHQVPSNCDCLNGGTCVSNKYFS<br>NIHWCNCPKKFGGQHCEIDKSKTCYEGNGHFYRGKASTDTM<br>GRPCLPWNSATVLQQTYHAHRSDALQLGLGKHNYCRNPDNR<br>RRPWCYVQVGLKPLVQECMVHDCA (SEQ ID NO: 145) |
| (cpIL-6 GP130 D1) | QNQWLQDMTTHLILRSFKEFLQSSLRALRQMSGGSGGGSSE<br>RIDKQIRYILDGISALRKETCNKSNMCESSKEALAENNLNL<br>PKMAEKDGCFQSGFNEETCLVKIITGLLEFEVYLEYLQNRF<br>ESSEEQARAVQMSTKVLIQFLQKKAKNLDAITTPDPTTNAS<br>LLTKLQASELLDPCGYISPESPVVQLHSNFTAVCVLKEKCM<br>DYFHVNANYIVWKTNHFTIPKEQYTIINRTASSVTFTDIAS<br>LNIQLTCNILTFGQLEQNVYGITIISG (SEQ ID NO: 146) |
| cpIL-6 GP130 D1:<br>human uPA: | QNQWLQDMTTHLILRSFKEFLQSSLRALRQMSGGSGGGSSE<br>RIDKQIRYILDGISALRKETCNKSNMCESSKEALAENNLNL<br>PKMAEKDGCFQSGFNEETCLVKIITGLLEFEVYLEYLQNRF<br>ESSEEQARAVQMSTKVLIQFLQKKAKNLDAITTPDPTTNAS<br>LLTKLQASELLDPCGYISPESPVVQLHSNFTAVCVLKEKCM<br>DYFHVNANYIVWKTNHFTIPKEQYTIINRTASSVTFTDIAS<br>LNIQLTCNILTFGQLEQNVYGITIISGGGSGGGGSGGSNEL<br>HQVPSNCDCLNGGTCVSNKYFSNIHWCNCPKKFGGQHCEID<br>KSKTCYEGNGHFYRGKASTDTMGRPCLPWNSATVLQQTYHA<br>HRSDALQLGLGKHNYCRNPDNRRRPWCYVQVGLKPLVQECM<br>VHDCA (SEQ ID NO: 147) |

Recombinant Procedures, Protein Expression and Protein Purification for Example 6

Gene Synthesis and Subcloning into a Mammalian Expression Vector

Synthesis and subcloning of the genes for expression of the designed constructs was carried out using standard molecular biology methods.

Protein Expression

All the proteins were expressed using the EXPI293™ Expression System Kit (ThermoFisher Scientific) following the manufacturer's protocol.

Protein Purification

After harvesting the expression culture supernatant, expressed protein was captured depending on the nature of the fusion protein. Proteins containing IgG Fc (mouse or human) were captured on a protein A column, and the column was washed with up to 5 column volume of PBS. The protein was eluted from the column by lowering the pH of the running buffer and directly neutralized with Tris buffer pH 8. The purified protein was then dialyzed overnight against PBS. For proteins containing a hexahistidine (6×His) fusion (SEQ ID NO: 241), protein in the supernatant was captured on Ni-NTA sepharose resin and eluted with increasing concentrations of imidazole. The purified protein was then dialyzed overnight against PBS.

Kinetics Measurements of Binding of IL-2 and IL-15-Based Fusion Proteins to Human or Mouse uPAR—Example 6

Recombinant mouse uPAR-Fc (R&D Systems, Cat. No. 531-PA-100) was captured on a BIACORE™ CMS sensor chip modified using the human antibody capture kit (GE Healthcare, Cat. No. BR100839) as per manufacturer's protocol. The test molecules were passed over the chip at a flow rate of 30 µl/min for 2 minutes in a stepwise manner with an increasing concentration range. Dissociation of analytes was measured for 10 minutes. The chip was regenerated by flowing over 3M MgCl$_2$ for 30 seconds. The resulting sensorgrams were analyzed with the native instrument software to calculate the binding affinities of the constructs, and the results are presented in Table 32.

Recombinant human uPAR his (R&D Systems, 807-UK-100/CF) was biotinylated and then captured on a BIACORE™ Streptavidin sensor chip per manufacturer's protocol. The molecules of interest, also referred to as analytes, were passed over the chip at a flow rate of 30 µl/min for 3 minutes in a stepwise manner with an increasing concentration range. Dissociation of analytes was measured for 20 minutes. The chip was regenerated by flowing over 3M MgCl$_2$ for 30 seconds. The resulting sensorgrams were analyzed with the native instrument software to calculate the binding affinities of the constructs, and the results are presented in Table 32.

Overall, human based IL-2 or IL-15 fusions to uPA-ATF bound tightly to human uPAR, in the range of 0.59-2.2 nM (see Table 32, SEQ ID NOs: 98, 99 and 100). These fusion molecules bound with slightly lower potency compared to the control molecule, SEQ ID NO: 20 (human uPA-ATF; 0.24 nM). IL-2 and IL-15 fusions to mouse uPA-ATF bind to mouse uPAR bound with similar potency (0.14-0.24 nM) to SEQ ID NO: 104 (mouse uPA-ATF; 0.14 nM). Additionally, SEQ ID NO: 110, which human cpIL-2: IL-2Ra fused to human uPA-ATF with the N22Y, W30R point mutants incorporate bound tightly to mouse uPAR, with a $K_D$ of 0.12 nM. These data indicate that fusion of IL-2 and IL-15-based sequences to a uPAR targeting moiety, in this case uPA-ATF fused at the N- or C-terminus, retain potent binding to uPAR in vitro.

TABLE 32

| Construct/SEQ ID NO: | Description | Target | $K_D$ (nM) | $K_{on}$ (1/Ms) | $k_d$ (1/s) |
|---|---|---|---|---|---|
| 98 | Human uPA-ATF Human cpIL-2:IL-2Ra:His$_6$ | Human uPAR | 2.2 | 4.6 × 10$^5$ | 1.0 × 10$^{-3}$ |
| 99 | Human cpIL-2: IL-2Ra:Human uPA-ATF-His$_6$ | Human uPAR | 0.59 | 8.3 × 10$^5$ | 4.9 × 10$^{-4}$ |
| 100 | Hise:Human uPA-ATF:hIL-15Ra:cpIL-15 | Human uPAR | 1.1 | 5.0 × 10$^5$ | 5.6 × 10$^{-4}$ |
| 101 | Mouse cpIL-2: IL-2Ra:mouse uPA-ATF-His$_6$ | Mouse uPAR | 0.19 | 1.3 × 10$^6$ | 2.6 × 10$^{-4}$ |
| 102 | Hise:Mouse uPA-ATF:mouse IL-15Ra:cpIL-15 | Mouse uPAR | 0.14 | 1.5 × 10$^6$ | 2.0 × 10$^{-4}$ |
| 103 | Human uPA-ATF:His$_6$ | Human uPAR | 0.24 | 1.5 × 10$^6$ | 3.5 × 10$^{-4}$ |
| 104 | Mouse uPA-ATF His$_6$ | Mouse uPAR | 0.15 | 2.2 × 10$^6$ | 3.2 × 10$^{-4}$ |
| 105 | Mouse uPA-ATF: Mouse cpIL-2:IL-2Ra:His$_6$ | Mouse uPAR | 0.14 | 1.4 × 10$^6$ | 2.0 × 10$^{-4}$ |
| 110 | Human cpIL-2: IL-2Ra:Human uPA-ATF (N22Y, W30R)-His$_6$ | Mouse uPAR | 0.12 | 1.9 × 10$^6$ | 2.3 × 10$^{-4}$ |

In Vitro Potency of Molecules Designed to Activate the IL-2 Receptor on Human T Cells—Example 6

In order to assess the potency of molecules containing human sequence-based fusions of IL-2 or IL-15, HH cells (ATCC® CRL-2105™) were incubated for 30 minutes with increasing concentrations of SEQ ID NOs: 98, 99, 100, 110, 94, 106, and 107. After incubation, cells were washed and lysed, and phosphorylation of STAT5 was detected using the STAT5 alpha/beta (Phospho) [pY694/pY699] Multispecies InstantOne™ ELISA Kit (ThermoFisher Scientific, Cat. No. 85-86112-11) as per the manufacturer's protocol. Phosphorylation of STAT5 is a receptor-proximal signaling event induced upon IL-2/IL-15 receptor activation. The data is shown in Table 33.

The non-targeted, parental circularly permuted cpIL-2: IL2Ra fusion protein, SEQ ID NO: 94, exhibited an $EC_{50}$ of 1.1 nM in the HH pSTAT5 assay. cpIL-2: IL2 Rα fusion proteins with a C-terminal uPAR targeting domain, i.e. SEQ ID NOs: 99, 106 and 110 were similarly potent, with $EC_{50S}$ of 1.5 nM, 1.6 nM, and 2.1 nM, respectively. SEQ ID NO: 98, a cpIL-2: IL2 Rα fusion protein with an N-terminal uPAR targeting domain was less potent with an $EC_{50}$ of 7-10 nM. The non-targeted, parental hIL-15Ra(sushi): cpIL-15 fusion protein, SEQ ID NO: 95 is more potent than SEQ ID NO: 94 with an $EC_{50}$ of 0.039 nM in the HH pSTAT5 assay. Variants of SEQ ID NO: 95 with an N-terminal targeting domain were also more potent than SEQ ID NO: 94, with $EC_{50S}$ of 0.18 nM and 0.099 nM for SEQ ID NOs: 100 and 107 respectively. In summary, targeted variants of SEQ ID NO: 94 with a C-terminal uPAR targeting domain and targeted variants of SEQ ID NO: 95 with an N-terminal targeting domain were all equipotent with their non-targeted parental molecules, suggesting that fusion to the uPAR targeting motif does not sterically hinder/interfere with the cytokine domains binding to their cognate receptor.

TABLE 33

| Construct/SEQ ID NO: | Description | pSTAT5 $EC_{50}$ (nM) |
|---|---|---|
| 94 | Human cpIL-2:IL-2Rα | 1.1 |
| 95 | Human IL-15Ra:cpIL-15 | 0.039 |
| 98 | Human uPA-ATF Human cpIL-2:IL-2Ra:His$_6$ | 7-10 |
| 99 | Human cpIL-2:IL-2Ra:Human uPA-ATF-His$_6$ | 1.5 |
| 100 | Hiss Human uPA-ATF: hIL-15Ra:cpIL-15 | 0.18 |
| 110 | Human cpIL-2:IL-2Ra: Human uPA-ATF (N22Y, W30R)-His$_6$ | 1.6 |
| 106 | Human cpIL-2:IL-2Ra:Fc:Human uPA-ATF | 2.1 |
| 107 | Human uPA-ATF:Fc:hIL-15Ra:cpIL-15 | 0.099 |

In Vitro Potency of Molecules Designed to Activate the IL-2 Receptor on Primary Mouse Splenocytes—Example 6

In order to query the potency of molecules containing mouse sequence-based fusions of IL-2 or IL-15, splenocytes were harvested from the spleens of wild-type mice, incubated for 30 minutes with increasing concentrations of SEQ ID NO: 96, a mouse Fc: mouse IL-15Ra:cpIL-15, SEQ ID NO: 101, SEQ ID NO: 102 and SEQ ID NO: 105. Cells were then fixed and stained with fluorescently-labeled antibodies against surface and intracellular markers to detect phosphorylation of STAT5 on mouse NK cells, CD8 T cells and CD4+CD25+ Foxp3+ regulatory T cells ($T_{regs}$) using standard flow cytometry techniques. The results are shown in Table 34.

Recombinant wild-type IL-2 (rIL-2) selectively stimulates cells that express the high affinity IL-2 receptor, which in normal mice and healthy humans is expressed mostly by $T_{regs}$. At much higher concentrations, rIL-2 can also activate NK cells and subsets of memory CD8 T cells due to their expression of the intermediate affinity IL-2 receptor complex. The circularly permuted mouse cpIL-2: IL2Rα fusion protein, SEQ ID NO: 96, was engineered to be more potent on cells expressing the intermediate affinity receptor relative to rIL-2. This is demonstrated by the equipotent induction of pSTAT5 in $T_{regs}$, NK cells, and memory CD8 T cells with $EC_{50S}$ of 21.6 nM, 19.0 nM, and 23.2 nM, respectively. A mouse cpIL-2: IL2 Rα fusion protein with a C-terminal uPAR targeting domain, i.e. SEQ ID NO: 101 was similarly potent on $T_{regs}$, NK cells, and memory CD8 T cells with $EC_{50S}$ of 16.5 nM, 19.5 nM, and 27.3 nM, respectively. Similarly, a mouse cpIL-2: IL2 Rα fusion protein with an N-terminal uPAR targeting domain, i.e. SEQ ID NO: 105, exhibited $EC_{50S}$ of 21.9 nM, 34.9 nM, and 38.0 nM on $T_{regs}$, NK cells, and memory CD8 T cells, respectively. In contrast to rIL-2, rmIL-15 does not exhibit selective activation for $T_{regs}$ as its affinity for the IL-2/IL-15 receptor complex is not enhanced by the presence of CD25. This is demonstrated by the similar induction of pSTAT5 in $T_{regs}$, NK cells, and memory CD8 T cells by the mouse Fc: mouse IL-15Ra: cpIL-15 with $EC_{50S}$ of 0.60 nM, 0.047 nM, and 0.15 nM, respectively. A mouse IL-15Ra(sushi):cpIL-15 fusion protein with an N-terminal uPAR targeting domain, i.e. SEQ ID NO: 102, exhibited similar potency on $T_{regs}$, NK cells, and memory CD8 T cells with $EC_{50S}$ of 1.7 nM, 0.15 nM, and 0.50 nM, respectively. As is the case for uPAR-targeted variants of SEQ ID NO: 94 and SEQ ID NO: 95, uPAR-targeted variants of the murine orthologs were all equipotent with their non-targeted parental molecules, suggesting that fusion to the uPAR targeting motif does not sterically hinder/interfere with the cytokine domains binding to their cognate receptor expressed on primary mouse $T_{regs}$, NK cells and memory CD8 T cells.

TABLE 34

| Construct/ SEQ ID NO: | Description | $T_{regs}$ $EC_{50}$ (nM) | NK Cell $EC_{50}$ (nM) | Memory CD8 T Cell $EC_{50}$ (nM) |
|---|---|---|---|---|
| 96 | Mouse cpIL-2:IL-2Ra | 22 | 19 | 23 |
| xx | mouse Fc:IL-15Ra:cpIL-15 | 0.60 | 0.047 | 0.15 |
| 101 | Mouse cpIL-2:IL-2Ra:mouse uPA-ATF-His$_6$ | 17 | 20 | 27 |
| 102 | His$_6$:Mouse uPA-ATF: mouse IL-15Ra:cpIL-15 | 1.7 | 0.15 | 0.50 |
| 105 | Mouse uPA-ATF:Mouse cpIL-2:IL-2Ra:His$_6$ | 22 | 35 | 38 |

Binding of IL-2 or IL-15-based Molecules to Mouse Tumor Cells Lines that Express uPAR—Example 6

Mouse syngeneic tumor lines 4T1, CT26, EMT6 (former all obtained from ATCC®) and MC38 (from NCI) were shown to express mouse uPAR on the cell surface by staining with a fluorescently labeled anti-mouse uPAR (CD87) antibody, as detected by flow cytometry. Adherent cells were lifted with CORNING® CELLSTRIPPER® Solution (Cat. No. 25056CI), washed, and then incubated with increasing concentrations of test molecules (see Table 35). After incubation at 4° C. for 60 min, cells were stained with a fluorescently-labeled anti-His antibody and analyzed using standard flow cytometry techniques. Mean fluorescence intensity were plotted against test article concentration and $EC_{50}$ values were calculated using a 4-parameter logistic curve fit.

TABLE 35

| Tumor Line | 4T1 $EC_{50}$ (nM) | CT26 $EC_{50}$ (nM) | EMT6 $EC_{50}$ (nM) | MC38 $EC_{50}$ (nM) |
|---|---|---|---|---|
| SEQ ID NO: 101 | 1.0 | 1.3 | 0.41 | 0.71 |
| SEQ ID NO: 102 | ND | ND | ND | 0.41 |
| SEQ ID NO: 103 | 0.22 | 1.1 | ND | 0.42 |
| SEQ ID NO: 110 | ND | 1.4 | 0.54 | ND |

Pharmacokinetics in MC38 Tumor-Bearing Mice of SEQ ID NO: 94 and SEQ ID NO: 110—Example 6

In order to determine the ratio of protein circulating in serum relative to tumors, a single dose PK experiment was carried out in MC38 tumor-bearing female C57BL/6 mice. Mice were dosed when tumors size ranged from 200-400 mm3. Mice were dosed subcutaneously with either 30 μg of SEQ ID NO: 94 or 75 μg SEQ ID NO: 110 at time 0, and then terminal bleeds were collected and processed to serum for each individual animal at 0.5, 2, 4, 8, and 24 hours post dose. Tumors from the same animals were also harvested and snap frozen for downstream concentration analysis. Serum samples were analyzed by a human IL-2-specific MSD (Meso-Scale Discovery) assay. Tumor samples were homogenized and concentrations measured by the same detection assay. Pharmacokinetic parameters were determined using a non-compartmental model in WinNonlin (Phoenix). The results are shown in Table 36.

When comparing the ratio of tumor exposure to systemic exposure (T/S) for both Cmax and AUC, SEQ ID NO: 110, a uPAR-targeted IL-2, showed a greater ratio of tumor penetration compared to the non-targeted control molecule SEQ ID NO: 94, which showed a similar ratio of exposure in the tumor relative to serum.

TABLE 36

| Construct/ SEQ ID NO: | Matrix | Cmax (nM) | Tmax (h) | AUClast (h*nM) | AUCinf (h*nM) | MRTinf (h) | t1/2 (h) | T/S (Cmax) (ratio) | T/S (AUCinf) (ratio) |
|---|---|---|---|---|---|---|---|---|---|
| 94 | Serum | 19.5 | 2 | 234 | 239 | 9.9 | 8.3 | NA | NA |
| 94 | Tumor | 23.2 | 2 | 189 | 191 | 6.6 | 8 | 1.2 | 0.8 |
| 110 | Serum | 2.9 | 4 | 29 | 29.1 | 7.3 | 6.3 | NA | NA |
| 110 | Tumor | 31.3 | 2 | 155 | 157 | 4.2 | 5.9 | 10.8 | 5.4 |

In Vitro Potency of Molecules Designed to Activate the IL-10 Receptor—Example 6

STAT3 phosphorylation is a receptor-proximal signaling event in response to binding and activating the IL-10 receptor. In order to query the potency of molecules containing fusions of IL-10, human peripheral blood mononuclear cells were incubated for 1 hour with increasing concentrations of scIL-10: CL:CH1: Fc (scIL10 3aa linker)); =SEQ ID NO: 136 which is equivalent to: scIL-10: CL:CH1: Fc plus 5AA linker plus huPA-ATF). Cells were then fixed and stained with fluorescently-labeled antibodies against surface and intracellular markers to detect phosphorylation of STAT3 on mouse B cells, monocytes, CD4 and CD8 T cells using standard flow cytometry techniques. The data is shown in Table 37.

Both molecules have very similar potency to each other across various cell types, supporting that fusion of IL-10 molecules to a uPAR targeting moiety, in this case the human uPA-ATF, does not affect the ability of the molecules to bind and activate the IL-10 receptor expressed on human immune cells.

TABLE 37

| Cell population | ScIL-10:CL:CHI:Fc (scIL 10 3aa linker) | SEQ ID NO: 136 |
|---|---|---|
| CD8 Central Memory T cells | 91.0 pM | 49.9 pM |
| CD4 Central Memory T cells | 80.6 pM | 111 pM |
| Monocytes | 0.060 pM | 0.037 pM |
| B cells | 0.057 pM | 0.127 pM |

In Vitro Potency of uPAR-Targeted Molecules Designed to Activate the IL-12 Receptor—Example 6

HEK-BLUE™ IL-12 cells (InvivoGen) are human embryonic kidney cells specifically designed to detect bioactive IL-12 in vitro by monitoring the IL-12-induced activation of the NF-κB/AP-1 pathways. The cell line expresses an inducible secreted embryonic alkaline phosphatase (SEAP) reporter gene under control of the STAT4-inducible promoter. HEK-Blue IL-1β cells were plated at 50,000 cells/well in DMEM media containing 4.5 g/L glucose and 2 mM L-glu and 10% heat inactivated FBS (Gibco). Cells were incubated for 20 hours at 37° C., 5% $CO_2$ with varying concentrations of IL-12 (R&D Systems, Cat. No. 219-IL-005/CF) or SEQ ID NO: 141. SEAP production was detected by adding QUANTI-Blue™ (InvivoGen) and incubating for 3 hours at 37° C., 5% $CO_2$ and then read on a plate reader at 630 nm.

The single chain human IL-12 construct fused to the human uPA-ATF construct of SEQ ID NO: 141 has similar potency (27 pM) compared to wild-type human IL-12 (18 pM) suggesting that fusion of IL-12 to uPA-ATF does not affect the ability of the IL-12 portion of the molecules to bind and activate the IL-12 receptor.

In Vitro Potency of uPAR-Targeted Molecules Designed to Active the Human 4-1BB Receptor—Example 6

Fusion proteins containing 4-1BB ligand were assayed using the 4-1BB Bioassay Kit from Promega. The assay uses 4-1BB effector cells that stably express 4-1BB and luciferase downstream of a response element. Luciferase expression is induced upon ligand binding to the receptor. The assay was performed per manufacturer's protocol. Dose response curves were generated by incubating test molecules at increasing concentrations and measuring generated light from expressed luciferase. The data is shown in Table 38.

Recombinant human 4-1BB ligand monomer (R&D Systems Cat. No. 2295-4L-025/CF) displayed no activity in the assay, suggesting that uncrosslinked 4-1BBL monomer is not able to activate 4-1BB, as 4-1BBL normally functions as a trimer. Linked 4-1BBL trimers fused to human uPA-ATF at the N- or C-terminus (SEQ ID NO: 130 and SEQ ID NO: 131) have more a more potent $EC_{50}$ (and higher maximal signal compared to a linked 4-1BBL trimer molecule that is not fused to the human uPA-ATF (SEQ ID NO: 129), which has an $EC_{50}$ of 0.15 nM. These results suggest that fusion to the human uPAR-targeting domain uPA-ATF may result in 2-3 fold more potent activity in signaling through 4-1BB, potentially due to avidity affects due to potent binding to uPAR on the cell surface. Nonetheless, fusion proteins of 4-1BBL to uPA-ATF are functionally able to bind and signal through 4-1BB.

TABLE 38

| Test molecule | description | $EC_{50}$ (nM) | Emax (luciferase units) |
|---|---|---|---|
| 4-1BBL monomer | Control (from R&D systems) | No activity | No activity |
| SEQ ID NO: 129 | linked human 4-1BBL Trimer | 0.15 | 193,000 |
| SEQ ID NO: 130 | Human uPA-ATF: linked human 4-1BBL Trimer | 0.046 | 266,000 |
| SEQ ID NO: 131 | Linked human 4-1BBL Trimer: Human uPA-ATF | 0.10 | 330,000 |

In Vitro Potency of Molecules Designed to Activate the GM-CSF Receptor on Human Monocytes—Example 6

In order to assess the potency of molecules containing human sequence-based fusions of GM-CSF, U937 cells (ATCC® CRL-1593.2™) were incubated for 30 minutes with increasing concentrations of recombinant human GM-CSF (R&D Systems, cat #215-GM-050/CF), SEQ ID NO: 138 or SEQ ID NO: 103. After incubation, cells were fixed, permeabilized and stained intracellularly with a fluorescently-labeled antibody specific for pSTAT5 and analyzed using standard flow cytometry techniques. The data is shown in Table 39.

Recombinant human GM-CSF (rhGM-CSF) is a potent inducer of STATS phosphorylation as demonstrated by an $EC_{50}$ of 18.6 pM in the U937 pSTAT5 assay. A human uPAR-targeting domain was fused at the C-terminal end of GM-CSF in SEQ ID NO: 138. SEQ ID NO: 138 was approximately 20-fold more potent in inducing STAT5 phosphorylation, with an $EC_{50}$ of 1.28 pM. Co-incubation of SEQ ID NO: 138 with increasing concentrations of the human uPAR-targeting domain alone, SEQ ID NO: 103, resulted in decreased potency, similar to rhGM-CSF alone. These results suggest that fusion of the uPAR-targeting motif to GM-CSF did not negatively impact the ability of the fusion protein to induce STATS phosphorylation as a result of receptor binding, rather it appears to enhance its activity.

TABLE 39

| Test molecule | Competitor | $EC_{50}$ (pM) |
|---|---|---|
| rhGM-CSF | none | 18.6 |
| SEQ ID NO: 138 | none | 1.28 |
| SEQ ID NO: 138 | 1 nM human uPA-ATF | 2.55 |
| SEQ ID NO: 138 | 100 nM human uPA-ATF | 14.0 |

In Vivo Pharmacokinetics of Exemplary Fusion Proteins

Select human anti-uPAR—IL-12 subunit fusion proteins were analyzed in vivo in mouse tumor models. Specifically, levels of the tested fusion proteins were detected in serum and tumor tissue of mice at several timepoints post administration. The fusion proteins used in this section are recited below in Table 40. Experimental details are outlined below in Table 41.

TABLE 40

Amino Acid Sequences of Fusion Proteins

| Description | Amino Acid Sequence/SEQ ID NO |
|---|---|
| p35-hM1-ScFv(vH3vL4)2 | RNLPVATPDPGMFPCLHHSQNLLRAVDNMLQKARQTLEFYP CTSEEIDHEDITKDKTSTVEACLPLELTKNESKLNSRETSF ITNGSCLASRKTSFMMALCLSSIYEDLKMYQVEFKTMNAKL LMDPKRQIFLDQNMLAVIDELMQALNFNSETVPQKSSLEEP DFYKTKIKLCILLHAFRIRAVTINRVMSYLNASGGGGSGGG |

TABLE 40-continued

Amino Acid Sequences of Fusion Proteins

| Description | Amino Acid Sequence/SEQ ID NO |
|---|---|
| | GSEVQLQQSGAEVKKPGATVKLSCTASGFNIKDEYINWVKQ<br>RPGQGLEWIGWIDPENGDTEYASKFQGRATITADTSTDTAY<br>LELSSLRSEDTAVYYCTGGNYVGWFPYWGQGTLVTVSSGGG<br>GSGGGGSGGGGSQIVLTQSPATLSASPGERVTMSCSASSSV<br>SYMHWYQQKPGTSPRRWLYDTSKLASGVPARFSGSGSGTDY<br>TLTISSLEPEDFATYYCQQWSSNPPYTFGQGTKLEIKGGSG<br>GGGSGGGSGGGGSGGGGSGGGSGGEVQLQQSGAEVKKPGAT<br>VKLSCTASGFNIKDEYINWVKQRPGQGLEWIGWIDPENGDT<br>EYASKFQGRATITADTSTDTAYLELSSLRSEDTAVYYCTGG<br>NYVGWFPYWGQGTLVTVSSGGGGSGGGGSGGGGSQIVLTQS<br>PATLSASPGERVTMSCSASSSVSYMHWYQQKPGTSPRRWLY<br>DTSKLASGVPARFSGSGSGTDYTLTISSLEPEDFATYYCQQ<br>WSSNPPYTFGQGTKLEIK (SEQ ID NO: 189) |
| p35-hM8-<br>ScFv(vB10vH3)2 | RNLPVATPDPGMFPCLHHSQNLLRAVDNMLQKARQTLEFYP<br>CTSEEIDHEDITKDKTSTVEACLPLELTKNESKLNSRETSF<br>ITNGSCLASRKTSFMMALCLSSIYEDLKMYQVEFKTMNAKL<br>LMDPKRQIFLDQNMLAVIDELMQALNFNSETVPQKSSLEEP<br>DFYKTKIKLCILLHAFRIRAVTINRVMSYLNASGGGGSGGG<br>GSDIQMTQSPSSLSASVGDTVTITCRTSENIYSNLAWYQQK<br>PGKSPQLLVYAATNLADGVPSRFSGSGSGTDYTLTISSLQP<br>EDFGTYYCQHFWGTPWTFGGGTKVEIKGGGSGGGGSGGGG<br>SQIQLVQSGSELKKPGASVKISCKASGTTFTDYGMNWVKQS<br>PGKGLKWMGWINTNTGEPTYAEDFKGRFVFSLDTSVSTAYL<br>QISSLKAEDTATYFCAHYSFDYWGQGTLLTVSSGGSGGGGS<br>GGGSGGGGSGGGGSGGGSGGDIQMTQSPSSLSASVGDTVTI<br>TCRTSENIYSNLAWYQQKPGKSPQLLVYAATNLADGVPSRF<br>SGSGSGTDYTLTISSLQPEDFGTYYCQHFWGTPWTFGGGTK<br>VEIKGGGGSGGGGSGGGGSQIQLVQSGSELKKPGASVKISC<br>KASGTTFTDYGMNWVKQSPGKGLKWMGWINTNTGEPTYAED<br>FKGRFVFSLDTSVSTAYLQISSLKAEDTATYFCAHYSFDYW<br>GQGTLLTVSS (SEQ ID NO: 213) |
| hM1-IgG1-p40<br>Heavy Chain<br>(hM1-IgG1(H3)-p40<br>(HC-fusion)) | EVQLQQSGAEVKKPGATVKLSCTASGFNIKDEYINWVKQRP<br>GQGLEWIGWIDPENGDTEYASKFQGRATITADTSTDTAYLE<br>LSSLRSEDTAVYYCTGGNYVGWFPYWGQGTLVTVSSASTKG<br>PSVFPLAPSSKSTSGGTAALGCLVKDYFPEPVTVSWNSGAL<br>TSGVHTFPAVLQSSGLYSLSSWTVPSSSLGTQTYICNVNHK<br>PSNTKVDKKVEPKSCDKTHTCPPCPAPEAAGGPSVFLFPPK<br>PKDTLMISRTPEVTCVVVDVSHEDPEVKFNWYVDGVEVHNA<br>KTKPREEQYNSTYRVVSVLTVLHQDWLNGKEYKCKVSNKAL<br>PAPIEKTISKAKGQPREPQVYTLPPSRDELTKNQVSLTCLV<br>KGFYPSDIAVEWESNGQPENNYKTTPPVLDSDGSFFLYSKL<br>TVDKSRWQQGNVFSCSVMHEALHNHYTQKSLSLSPGKGGGG<br>SGGGGSIWELKKDVYVVELDWYPDAPGEMVVLTCDTPEEDG<br>ITWTLDQSSEVLGSGKTLTIQVKEFGDAGQYTCHKGGEVLS<br>HSLLLLHKKEDGIWSTDILKDQKEPKNKTFLRCEAKNYSGR<br>FTCWWLTTISTDLTFSVKSSRGSSDPQGVTCGAATLSAERV<br>RGDNKEYEYSVECQEDSASPAAEESLPIEVMVDAVHKLKYE<br>NYTSSFFIRDIIKPDPPKNLQLKPLKNSRQVEVSWEYPDTW<br>STPHSYFSLTFSVQVQGKSKREKKDRVFTDKTSATVICRKN<br>ASISVRAQDRYYSSSWSEWASVPCS (SEQ ID NO:<br>178) |
| hM1-IgG1-p40 Light<br>Chain<br>(hM1-L3 (Kappa<br>LC)) | EIVLTQSPATLSLSPGERATLSCSASSSVSYMHWYQQKPGT<br>SPRRWIYDTSKLASGVPARFSGSGSGTDFTLTISSLEPEDF<br>AVYYCQQWSSNPPYTFGQGTKLEIKRTVAAPSVFIFPPSDE<br>QLKSGTASVVCLLNNFYPREAKVQWKVDNALQSGNSQESVT<br>EQDSKDSTYSLSSTLTLSKADYEKHKVYACEVTHQGLSSPV<br>TKSFNRGEC (SEQ ID NO: 159) |
| hM8-IgG1-p40<br>Heavy Chain<br>(hM8-IgG1(H3)-p40<br>(HC-fusion)) | QIQLVQSGSELKKPGASVKISCKASGTTFTDYGMNWVKQSP<br>GKGLKWMGWINTNTGEPTYAEDFKGRFVFSLDTSVSTAYLQ<br>ISSLKAEDTATYFCAHYSFDYWGQGTLLTVSSASTKGPSVF<br>PLAPSSKSTSGGTAALGCLVKDYFPEPVTVSWNSGALTSGV<br>HTFPAVLQSSGLYSLSSVVTVPSSSLGTQTYICNVNHKPSN<br>TKVDKKVEPKSCDKTHTCPPCPAPEAAGGPSVFLFPPKPKD<br>TLMISRTPEVTCVVVDVSHEDPEVKFNWYVDGVEVHNAKTK<br>PREEQYNSTYRVVSVLTVLHQDWLNGKEYKCKVSNKALPAP<br>IEKTISKAKGQPREPQVYTLPPSRDELTKNQVSLTCLVKGF<br>YPSDIAVEWESNGQPENNYKTTPPVLDSDGSFFLYSKLTVD<br>KSRWQQGNVFSCSVMHEALHNHYTQKSLSLSPGKGGGGSGG<br>GGSIWELKKDVYVVELDWYPDAPGEMVVLTCDTPEEDGITW<br>TLDQSSEVLGSGKTLTIQVKEFGDAGQYTCHKGGEVLSHSL<br>LLHKKEDGIWSTDILKDQKEPKNKTFLRCEAKNYSGRFTC<br>WWLTTISTDLTFSVKSSRGSSDPQGVTCGAATLSAERVRGD |

TABLE 40-continued

Amino Acid Sequences of Fusion Proteins

| Description | Amino Acid Sequence/SEQ ID NO |
|---|---|
| | NKEYEYSVECQEDSASPAAEESLPIEVMVDAVHKLKYENYT SSFFIRDIIKPDPPKNLQLKPLKNSRQVEVSWEYPDTWSTP HSYFSLTFSVQVQGKSKREKKDRVFTDKTSATVICRKNASI SVRAQDRYYSSSWSEWASVPCS (SEQ ID NO: 193) |
| hM8-IgG1-p40 Light Chain (hM8-B2 (Kappa LC)) | DIQMTQSPSSLSASVGDTVTITCRTSENIYSNLAWYQQKPG KSPQLLVYAATNLADGVPSRFSGSGSGTQYTLKISSLQPED FATYYCQHFWGTPWTFGGGTKVEIKRTVAAPSVFIFPPSDE QLKSGTASVVCLLNNFYPREAKVQWKVDNALQSGNSQESVT EQDSKDSTYSLSSTLTLSKADYEKHKVYACEVTHQGLSSPV TKSFNRGEC (SEQ ID NO: 161) |
| hM1-Fab-p40 Heavy Chain (hM1-Fab(H3)-p40 (HC-fusion)) | EVQLQQSGAEVKKPGATVKLSCTASGFNIKDEYINWVKQRP GQGLEWIGWIDPENGDTEYASKFQGRATITADTSTDTAYLE LSSLRSEDTAVYYCTGGNYVGWFPYWGQGTLVTVSSASTKG PSVFPLAPSSKSTSGGTAALGCLVKDYFPEPVTVSWNSGAL TSGVHTFPAVLQSSGLYSLSSWTVPSSSLGTQTYICNVNHK PSNTKVDKKVEPKSCGGGGSGGGGSIWELKKDVYVVELDWY PDAPGEMVVLTCDTPEEDGITWTLDQSSEVLGSGKTLTIQV KEFGDAGQYTCHKGGEVLSHSLLLLHKKEDGIWSTDILKDQ KEPKNKTFLRCEAKNYSGRFTCWWLTTISTDLTFSVKSSRG SSDPQGVTCGAATLSAERVRGDNKEYEYSVECQEDSASPAA EESLPIEVMVDAVHKLKYENYTSSFFIRDIIKPDPPKNLQL KPLKNSRQVEVSWEYPDTWSTPHSYFSLTFSVQVQGKSKRE KKDRVFTDKTSATVICRKNASISVRAQDRYYSSSWSEWASV PCS (SEQ ID NO: 179) |
| hM1-Fab-p40 Light Chain (hM1-L3 (Kappa LC)) | EIVLTQSPATLSLSPGERATLSCSASSSVSYMHWYQQKPGT SPRRWIYDTSKLASGVPARFSGSGSGTDFTLTISSLEPEDF AVYYCQQWSSNPPYTFGQGTKLEIKRTVAAPSVFIFPPSDE QLKSGTASVVCLLNNFYPREAKVQWKVDNALQSGNSQESVT EQDSKDSTYSLSSTLTLSKADYEKHKVYACEVTHQGLSSPV TKSFNRGEC (SEQ ID NO: 159) |
| hM8-Fab-p40 Heavy Chain (hM8-Fab(H3)-p40 (HC fusion)) | QIQLVQSGSELKKPGASVKISCKASGTTFTDYGMNWVKQSP GKGLKWMGWINTNTGEPTYAEDFKGRFVFSLDTSVSTAYLQ ISSLKAEDTATYFCAHYSFDYWGQGTLLTVSSASTKGPSVF PLAPSSKSTSGGTAALGCLVKDYFPEPVTVSWNSGALTSGV HTFPAVLQSSGLYSLSSVVTVPSSSLGTQTYICNVNHKPSN TKVDKKVEPKSCGGGGSGGGGSIWELKKDVYVVELDWYPDA PGEMVVLTCDTPEEDGITWTLDQSSEVLGSGKTLTIQVKEF GDAGQYTCHKGGEVLSHSLLLLHKKEDGIWSTDILKDQKEP KNKTFLRCEAKNYSGRFTCWWLTTISTDLTFSVKSSRGSSD PQGVTCGAATLSAERVRGDNKEYEYSVECQEDSASPAAEES LPIEVMVDAVHKLKYENYTSSFFIRDIIKPDPPKNLQLKPL KNSRQVEVSWEYPDTWSTPHSYFSLTFSVQVQGKSKREKKD RVFTDKTSATVICRKNASISVRAQDRYYSSSWSEWASVPCS (SEQ ID NO: 194) |
| hM8-Fab-p40 Light Chain (hM8-B5 (Kappa LC)) | DIQMTQSPSSLSASVGDRVTITCRTSENIYSNLAWYQQKPG KSPQLLVYAATNLADGVPSRFSGSGSGTDYTLTISSLQPED FGTYYCQHFWGTPWTFGGGTKVEIKRTVAAPSVFIFPPSDE QLKSGTASVVCLLNNFYPREAKVQWKVDNALQSGNSQESVT EQDSKDSTYSLSSTLTLSKADYEKHKVYACEVTHQGLSSPV TKSFNRGEC (SEQ ID NO: 162) |
| p35-hM1-Fab-KiH Heavy Chain (hM1-Fab(H3)-KiH (knob)) | EVQLQQSGAEVKKPGATVKLSCTASGFNIKDEYINWVKQRP GQGLEWIGWIDPENGDTEYASKFQGRATITADTSTDTAYLE LSSLRSEDTAVYYCTGGNYVGWFPYWGQGTLVTVSSASTKG PSVFPLAPSSKSTSGGTAALGCLVKDYFPEPVTVSWNSGAL TSGVHTFPAVLQSSGLYSLSSWTVPSSSLGTQTYICNVNHK PSNTKVDKKVEPKSCDKTHTCPPCPAPEAAGGPSVFLFPPK PKDTLMISRTPEVTCVVVDVSHEDPEVKFNWYVDGVEVHNA KTKPREEQYNSTYRVVSVLTVLHQDWLNGKEYKCKVSNKAL GAPIEKTISKAKGQPREPQVCTLPPSREEMTKNQVSLWCLV KGFYPSDIAVEWESNGQPENNYKTTPPVLDSDGSFFLYSKL TVDKSRWQQGNVFSCSVMHEALHNHYTQKSLSLSPGK (SEQ ID NO: 238) |
| p35-hM1-Fab-KiH Light Chain (hM1-L3 (Kappa LC)) | EIVLTQSPATLSLSPGERATLSCSASSSVSYMHWYQQKPGT SPRRWIYDTSKLASGVPARFSGSGSGTDFTLTISSLEPEDF AVYYCQQWSSNPPYTFGQGTKLEIKRTVAAPSVFIFPPSDE QLKSGTASVVCLLNNFYPREAKVQWKVDNALQSGNSQESVT EQDSKDSTYSLSSTLTLSKADYEKHKVYACEVTHQGLSSPV TKSFNRGEC (SEQ ID NO: 159) |

TABLE 40-continued

Amino Acid Sequences of Fusion Proteins

| Description | Amino Acid Sequence/SEQ ID NO |
|---|---|
| p35-hM1-Fab-KiH (p35-Fab-KiH (hole)) | RNLPVATPDPGMFPCLHHSQNLLRAVDNMLQKARQTLEFYP CTSEEIDHEDITKDKTSTVEACLPLELTKNESKLNSRETSF ITNGSCLASRKTSFMMALCLSSIYEDLKMYQVEFKTMNAKL LMDPKRQIFLDQNMLAVIDELMQALNFNSETVPQKSSLEEP DFYKTKIKLCILLHAFRIRAVTINRVMSYLNASGGGSGGGG SGEPKSSDKTHTCPPCPAPEAAGGPSVFLFPPKPKDTLMIS RTPEVTCVVVDVSHEDPEVKFNWYVDGVEVHNAKTKPREEQ YNSTYRVVSVLTVLHQDWLNGKEYKCKVSNKALGAPIEKTI SKAKGQPREPQVYTLPPCREEMTKNQVSLSCAVKGFYPSDI AVEWESNGQPENNYKTTPPVLDSDGSFFLVSKLTVDKSRWQ QGNVFSCSVMHEALHNRFTQKSLSLSPGK (SEQ ID NO: 239) |

TABLE 41

Assay Details

| Group | Number of animals | Test Article | Structure | Dose Route | Target Dose Level (mg/kg) | Detection Assay |
|---|---|---|---|---|---|---|
| 1 | 6 | vehicle | | | | |
| 2 | 36 | SEQ ID NO: 213 | p35-hM8-ScFv2 | bolus | 40 | MSD anti-human P35 assay |
| 3 | 36 | SEQ ID NO: 213 | p35-hM8-ScFv2 | infusion | 40 | MSD anti-human P35 assay |
| 4 | 36 | SEQ ID NO: 189 | p35-hM1-ScFv2 | bolus | 40 | MSD anti-human P35 assay |
| 5 | 36 | SEQ ID NO: 179 & SEQ ID NO: 159 | hM1-Fab-P40 | bolus | 6.9 | MSD Human IL-12p40 V-Plex Kit |
| 6 | 36 | SEQ ID NO: 213 (0.5 h prior to P40) SEQ ID NO: 178 & SEQ ID NO: 159 | p35-hM8-ScFv2 hM1-IgG-P40 | infusion bolus | 40 11.7 | MSD Human IL-12p70 V-Plex Kit |
| 7 | 36 | SEQ ID NO: 213 (4 h prior to P40) SEQ ID NO: 178 & SEQ ID NO: 159 | p35-hM8-ScFv2 hM1-IgG-P40 | infusion bolus | 40 11.7 | MSD Human IL-12p70 V-Plex Kit |

The model used in the above study was the SC RKO human colorectum cancer xenograft model in female NOD/SCID mice. To generate the tumor model, each mouse was inoculated subcutaneously with RKO tumor cells. Randomization was used when tumor size reached ~250 mm³. Tumor and serum samples were taken at 0.5, 1, 4, 24, 48, 72 hours post last dose. The Meso Scale Discovery (MSD) assays were used for the detection of p35, p40, or p70 in the samples accordingly to manufacture protocols.

Figure 11:
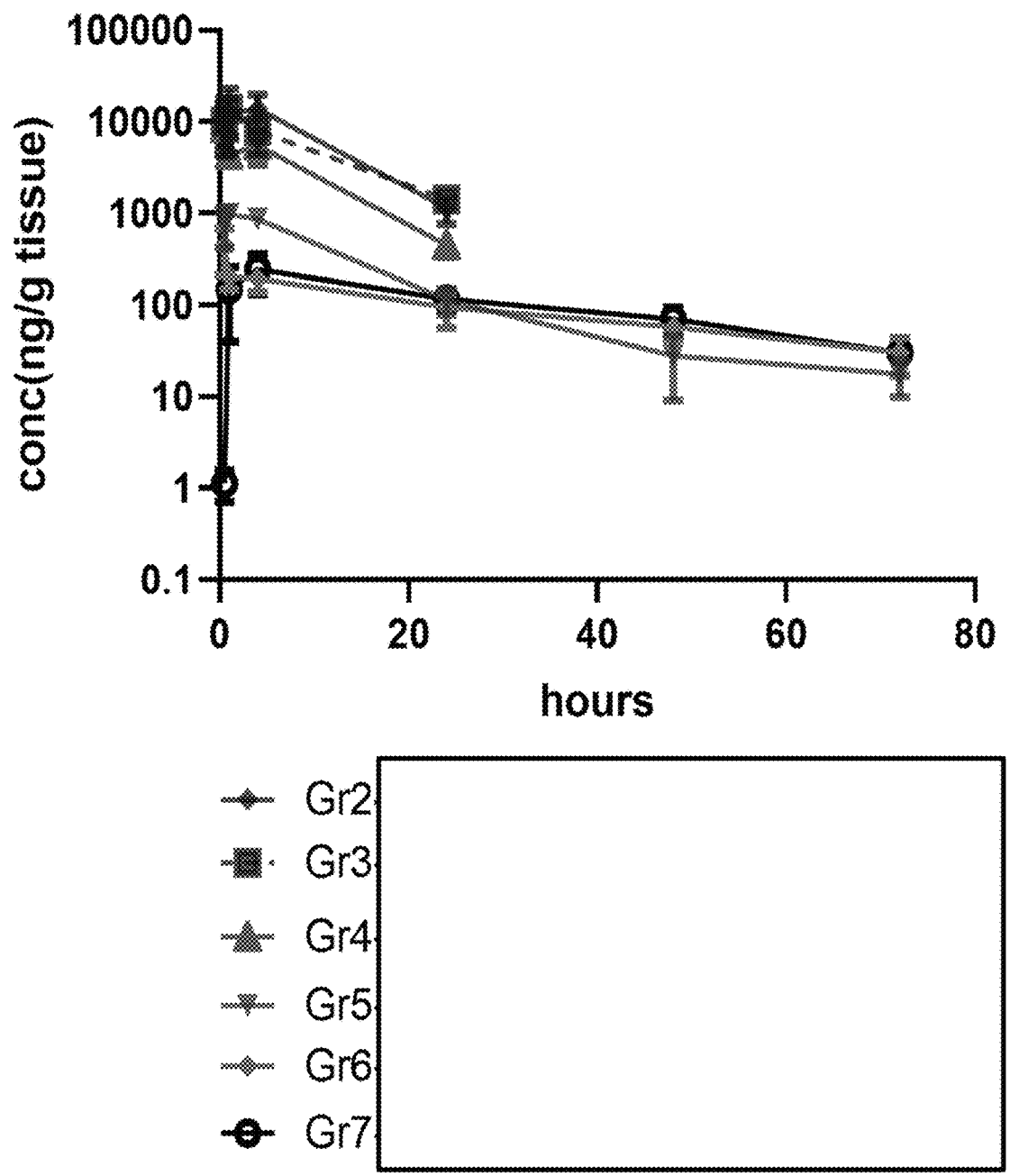
FIG. 11 depicts accumulation of select fusion proteins in tumor tissue in an RKO xenograft tumor mouse model.
Figure 12:
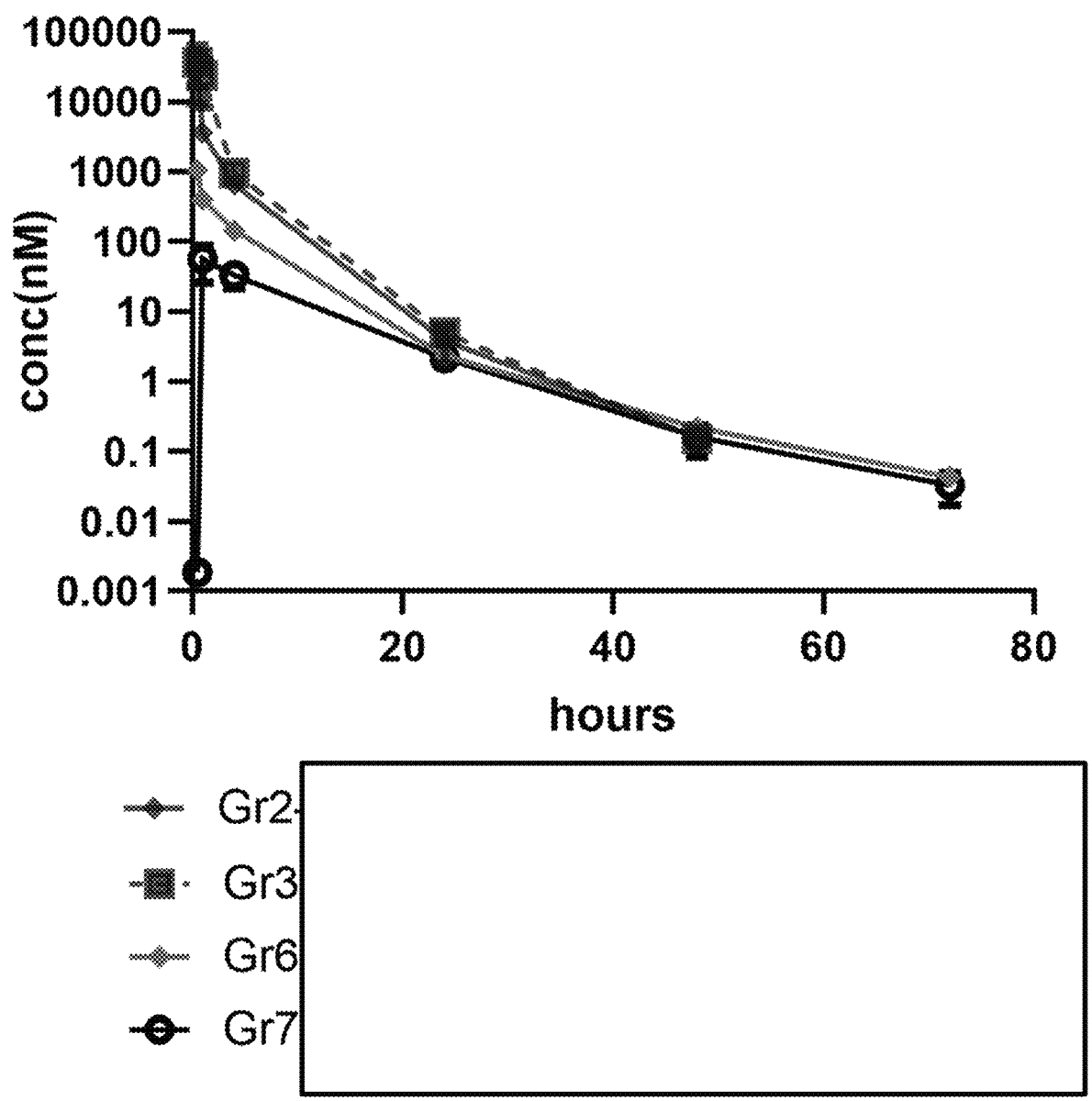
FIG. 12 depicts accumulation of select fusion proteins in serum in an RKO xenograft tumor mouse model.

As shown in FIG. 11, the tested fusion proteins in each Group were detected in tumor tissue at all timepoints testes, with levels remaining relatively stable. The data shows that the fusion proteins productively accumulate in tumor tissue. As shown in FIG. 12, for select Groups, the level of the fusion proteins in serum steadily dropped over time, demonstrating that the fusion protein is rapidly cleared from the system except for fusion protein in the target tumor tissue.

SEQUENCE LISTING (273 sequences)

SEQ ID NO: 1 - protein, 118 aa, Artificial Sequence
  Description of Artificial Sequence: Synthetic polypeptide
EVQLQQSGAELVRPGASVKLSCTASGFNIKDEYINWVKQRPEQGLEWIGWIDPENGDTEYASKFQGKATITADTSSNTAYLQLSSLTSEDTAVYYCTGGNYVGWFPYWGQGTLVTVSA

SEQ ID NO: 2 - protein, 107 aa, Artificial Sequence
  Description of Artificial Sequence: Synthetic polypeptide
QIVLTQSPAIMSASPGEKVTMTCSASSSVSYMHWYQQKSGTSPKRWLYDTSKLASGVPARFSGSGSGTSYSLTISSMEAEDAATYYCQQWSSNPPYTFGGGTKLEIK

SEQ ID NO: 3 - protein, 8 aa, Artificial Sequence
  Description of Artificial Sequence: Synthetic peptide
GFNIKDEY

SEQ ID NO: 4 - protein, 8 aa, Artificial Sequence
  Description of Artificial Sequence: Synthetic peptide
IDPENGDT

SEQ ID NO: 5 - protein, 11 aa, Artificial Sequence
  Description of Artificial Sequence: Synthetic peptide
TGGNYVGWFPY

SEQ ID NO: 6 - protein, 5 aa, Artificial Sequence
  Description of Artificial Sequence: Synthetic peptide
SSVSY

SEQ ID NO: 7 - protein, 3 aa, Artificial Sequence
  Description of Artificial Sequence: Synthetic peptide
DTS

SEQ ID NO: 8 - protein, 9 aa, Artificial Sequence
  Description of Artificial Sequence: Synthetic peptide
QQWSSNPPY

SEQ ID NO: 9 - protein, 117 aa, Artificial Sequence
  Description of Artificial Sequence: Synthetic polypeptide
QVQLKESGPGLVAPSQSLSITCTVSGFSLTNYGVHWVRQPPGKDLEWLVVIWSDGGTTYNSALKSRLSISKDNSKSQVFLKMNSLQTDDTAMYYCARGGRSDLFAYWGQGTLVTVSA

SEQ ID NO: 10 - protein, 112 aa, Artificial Sequence
  Description of Artificial Sequence: Synthetic polypeptide
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 11 - protein, 8 aa, Artificial Sequence
  Description of Artificial Sequence: Synthetic peptide
GFSLTNYG

SEQ ID NO: 12 - protein, 7 aa, Artificial Sequence
  Description of Artificial Sequence: Synthetic peptide
IWSDGGT

SEQ ID NO: 13 - protein, 11 aa, Artificial Sequence
  Description of Artificial Sequence: Synthetic peptide
ARGGRSDLFAY

SEQ ID NO: 14 - protein, 11 aa, Artificial Sequence
  Description of Artificial Sequence: Synthetic peptide
QSIVHSNGNTY

SEQ ID NO: 15 - protein, 3 aa, Artificial Sequence
  Description of Artificial Sequence: Synthetic peptide
KVS

SEQ ID NO: 16 - protein, 9 aa, Artificial Sequence
  Description of Artificial Sequence: Synthetic peptide
FQGSHVPYT

SEQ ID NO: 17 - protein, 114 aa, Artificial Sequence
  Description of Artificial Sequence: Synthetic polypeptide
QIQLVQSGPELKKPGETVKISCKASGNTFTDYGMNWVKQSPGKGLKWMGWINTNTGEPTYADDFKGRFAFSLETSASTAYLQINNLKNEDMATYFCAHYSFDYWGQGTTLTVSS

SEQ ID NO: 18 - protein, 107 aa, Artificial Sequence
  Description of Artificial Sequence: Synthetic polypeptide
DIQMTQSPASLSVSVGQTVTITCRTSENIYSNLAWYQQKPGKSPQLLVYAATNLADGVPSRFSGSGSGTQYSLKINSLQSEDFGSYYCQHFWGTPWTFGGGTKLEIK

SEQ ID NO: 19 - protein, 8 aa, Artificial Sequence
  Description of Artificial Sequence: Synthetic peptide
GNTFTDYG

SEQ ID NO: 20 - protein, 8 aa, Artificial Sequence
  Description of Artificial Sequence: Synthetic peptide
INTNTGEP

SEQ ID NO: 21 - protein, 7 aa, Artificial Sequence
  Description of Artificial Sequence: Synthetic peptide
AHYSFDY

SEQ ID NO: 22 - protein, 6 aa, Artificial Sequence
  Description of Artificial Sequence: Synthetic peptide
ENIYSN

SEQ ID NO: 23 - protein, 3 aa, Artificial Sequence
  Description of Artificial Sequence: Synthetic peptide
AAT

SEQ ID NO: 24 - protein, 9 aa, Artificial Sequence
  Description of Artificial Sequence: Synthetic peptide
QHFWGTPWT

SEQ ID NO: 25 - protein, 119 aa, Artificial Sequence
  Description of Artificial Sequence: Synthetic polypeptide
QVQLQQSGAELARPGASVNLSCKASGYTFTSYGISWVKQRTGQGLEWIGEIYPRSGNTYYNEKFKGKATLTADKSSRTAYMELRSLTSEDSAVYFCAGKDYGSTYADYWGQGTTLTVSS

SEQ ID NO: 26 - protein, 108 aa, Artificial Sequence
  Description of Artificial Sequence: Synthetic polypeptide
QIVLTQSPAIMSASPGEKVTMTCSASSSVSSRYLHWYQQKSGASPKLWIYGTSNLASGVPARFSGSGSGTSYSLTINSVEAEDAATYYCQQYHSDPLTFGAGTKLELK

SEQ ID NO: 27 - protein, 8 aa, Artificial Sequence
  Description of Artificial Sequence: Synthetic peptide
GYTFTSYG

SEQ ID NO: 28 - protein, 8 aa, Artificial Sequence
  Description of Artificial Sequence: Synthetic peptide
IYPRSGNT

SEQ ID NO: 29 - protein, 12 aa, Artificial Sequence
  Description of Artificial Sequence: Synthetic peptide
AGKDYGSTYADY

SEQ ID NO: 30 - protein, 7 aa, Artificial Sequence
  Description of Artificial Sequence: Synthetic peptide
SSVSSRY

SEQ ID NO: 31 - protein, 3 aa, Artificial Sequence
  Description of Artificial Sequence: Synthetic peptide
GTS

SEQ ID NO: 32 - protein, 9 aa, Artificial Sequence
  Description of Artificial Sequence: Synthetic peptide
QQYHSDPLT

SEQ ID NO: 33 - protein, 118 aa, Artificial Sequence
  Description of Artificial Sequence: Synthetic polypeptide
EVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSS

SEQ ID NO: 34 - protein, 118 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSS

SEQ ID NO: 35 - protein, 107 aa, Artificial Sequence
  Description of Artificial Sequence: Synthetic polypeptide
EIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIK

SEQ ID NO: 36 - protein, 107 aa, Artificial Sequence
  Description of Artificial Sequence: Synthetic polypeptide
QIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIK

SEQ ID NO: 37 - protein, 114 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSS

SEQ ID NO: 38 - protein, 107 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIK

SEQ ID NO: 39 - protein, 107 aa, Artificial Sequence
  Description of Artificial Sequence: Synthetic polypeptide
DIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIK

SEQ ID NO: 40 - protein, 107 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIK

SEQ ID NO: 41 - protein, 8 aa, Artificial Sequence
  Description of Artificial Sequence: Synthetic peptide
GTTFTDYG

SEQ ID NO: 42 - protein, 119 aa, Artificial Sequence
  Description of Artificial Sequence: Synthetic polypeptide
QVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSS

SEQ ID NO: 43 - protein, 119 aa, Artificial Sequence
  Description of Artificial Sequence: Synthetic polypeptide
QVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSS

SEQ ID NO: 44 - protein, 108 aa, Artificial Sequence
  Description of Artificial Sequence: Synthetic polypeptide
QIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELK

SEQ ID NO: 45 - protein, 448 aa, Artificial Sequence
  Description of Artificial Sequence: Synthetic polypeptide
EVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 448 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 213 aa, Artificial Sequence
  Description of Artificial Sequence: Synthetic polypeptide
EIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 48 - protein, 213 aa, Artificial Sequence
  Description of Artificial Sequence: Synthetic polypeptide
QIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 444 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 213 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 51 - protein, 213 aa, Artificial Sequence
  Description of Artificial Sequence: Synthetic polypeptide
DIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 213 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 53 - protein, 449 aa, Artificial Sequence
  Description of Artificial Sequence: Synthetic polypeptide
QVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 449 aa, Artificial Sequence
  Description of Artificial Sequence: Synthetic polypeptide
QVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 214 aa, Artificial Sequence
  Description of Artificial Sequence: Synthetic polypeptide
QIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 56 - protein, 240 aa, Artificial Sequence
  Description of Artificial Sequence: Synthetic polypeptide
EVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIK

SEQ ID NO: 57 - protein, 240 aa, Artificial Sequence
  Description of Artificial Sequence: Synthetic polypeptide
QIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSGGGGSEVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSS

SEQ ID NO: 58 - protein, 240 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSEIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIK

SEQ ID NO: 59 - protein, 240 aa, Artificial Sequence
  Description of Artificial Sequence: Synthetic polypeptide
EIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKGGGGSGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSS

SEQ ID NO: 60 - protein, 240 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIK

SEQ ID NO: 61 - protein, 240 aa, Artificial Sequence
  Description of Artificial Sequence: Synthetic polypeptide
QIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSS

SEQ ID NO: 62 - protein, 236 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIK

SEQ ID NO: 63 - protein, 236 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSS

SEQ ID NO: 64 - protein, 236 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIK

SEQ ID NO: 65 - protein, 236 aa, Artificial Sequence
  Description of Artificial Sequence: Synthetic polypeptide
DIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSS

SEQ ID NO: 66 - protein, 236 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIK

SEQ ID NO: 67 - protein, 236 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSS

SEQ ID NO: 68 - protein, 242 aa, Artificial Sequence
  Description of Artificial Sequence: Synthetic polypeptide
QVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSGGGGSGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELK

SEQ ID NO: 69 - protein, 242 aa, Artificial Sequence
  Description of Artificial Sequence: Synthetic polypeptide
QIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSGGGGSQVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSS

SEQ ID NO: 70 - protein, 242 aa, Artificial Sequence
  Description of Artificial Sequence: Synthetic polypeptide
QVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSGGGGSGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELK

SEQ ID NO: 71 - protein, 242 aa, Artificial Sequence
  Description of Artificial Sequence: Synthetic polypeptide
QIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSGGGGSQVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSS

SEQ ID NO: 72 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 77 - protein, 232 aa, Artificial Sequence
  Description of Artificial Sequence: Synthetic polypeptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 232 aa, Artificial Sequence
  Description of Artificial Sequence: Synthetic polypeptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 79 - protein, 103 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 80 - protein, 106 aa, Artificial Sequence
  Description of Artificial Sequence: Synthetic polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 81 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 82 - protein, 197 aa, Artificial Sequence
  Description of Artificial Sequence: Synthetic polypeptide
RNLPVATPDPGMFPCLHHSQNLLRAVSNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 83 - protein, 197 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNAS

SEQ ID NO: 84 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 85 - protein, 306 aa, Artificial Sequence
  Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 86 - protein, 306 aa, Artificial Sequence
  Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 87 - protein, 306 aa, Artificial Sequence
  Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 88 - protein, 513 aa, Artificial Sequence
  Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 89 - protein, 513 aa, Artificial Sequence
  Description of Artificial Sequence: Synthetic polypeptide
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGSGGGGSGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 90 - protein, 431 aa, Homo sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 91 - protein, 132 aa, Homo sapiens
SNELHQVPSNCDCLNGGTCVSYKYFSNIHRCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 92 - skipped

SEQ ID NO: 93 - protein, 433 aa, Mus musculus
MKVWLASLFLCALVVKNSEGGSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCSLSKKPSSSVDQQGFQCGQKALRPRFKIVGGEFTEVENQPWFAAIYQKNKGGSPPSFKCGGSLISPCWVASAAHCFIQLPKKENYVVYLGQSKESSYNPGEMKFEVEQLILHEYYREDSLAYHNDIALLKIRTSTGQCAQPSRSIQTICLPPRFTDAPFGSDCEITGFGKESESDYLYPKNLKMSVVKLVSHEQCMQPHYYGSEINYKMLCAADPEWKTDSCKGDSGGPLICNIEGRPTLSGIVSWGRGCAEKNKPGVYTRVSHFLDWIQSHIGEEKGLAF

SEQ ID NO: 94 - protein, 303 aa, Artificial Sequence
  Description of Artificial Sequence: Synthetic polypeptide
SKNFHLRPRDLISNINVIVLELKGSETTFMCEYADETATIVEFLNRWITFSQSIISTLTGGSSSTKKTQLQLEHLLLDLQMILNGINNYKNPKLTRMLTFKFYMPKKATELKHLQCLEEELKPLEEVLNLAQGSGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTG

SEQ ID NO: 95 - protein, 184 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDGGSELEEKNIKEFLQSFVHIVQMFINGGGSNWVNVISDLKKIEDLIQSMHIDATLYTESDVHPSCKVTAMKCFLLELQVISLESGDASIHDTVENLIILANNSLSSNGNVTESGCKEC

SEQ ID NO: 96 - protein, 302 aa, Artificial Sequence
  Description of Artificial Sequence: Synthetic polypeptide
SSKSFQLEDAENFISNIRVTVVKLKGSDNTFECQFDDESATVVDFLRRWIAFCQSIISTSPQGGSSSTQQQQQHLEQLLMDLQELLSRMENYRNLKLPRMLTFKFYLPKQATELKDLQCLEDELGPLRHVLDLTQGSGGGSELCLYDPPEVPNATFKALSYKNGTILNCECKRGFRRLKELVYMRCLGNSWSSNCQCTSNSHDKSRKQVTAQLEHQKEQQTTTDMQKPTQSMHQENLTGHCREPPPWKHEDSKRIYHFVEGQSVHYECIPGYKALQRGPAISICKMKCGKTGWTQPQLTCVD

SEQ ID NO: 97 - protein, 184 aa, Artificial Sequence
  Description of Artificial Sequence: Synthetic polypeptide
TTCPPPVSIEHADIRVKNYSVNSRERYVCNSGFKRKAGTSTLIECVINKNTNVAHWTTPSLKCIRDGGSELEEKTFTEFLQSFIRIVQMFINGGGSNWIDVRYDLEKIESLIQSIHIDTTLYTDSDFHPSCKVTAMNCFLLELQVILHEYSNMTLNETVRNVLYLANSTLSSNKNVAESGCKEC

SEQ ID NO: 98 - protein, 440 aa, Artificial Sequence
  Description of Artificial Sequence: Synthetic polypeptide
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCAGGSGGSKNFHLRPRDLISNINVIVLELKGSETTFMCEYADETATIVEFLNRWITFSQSIISTLTGGSSSTKKTQLQLEHLLLDLQMILNGINNYKNPKLTRMLTFKFYMPKKATELKHLQCLEEELKPLEEVLNLAQGSGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTG

SEQ ID NO: 99 - protein, 440 aa, Artificial Sequence
  Description of Artificial Sequence: Synthetic polypeptide
SKNFHLRPRDLISNINVIVLELKGSETTFMCEYADETATIVEFLNRWITFSQSIISTLTGGSSSTKKTQLQLEHLLLDLQMILNGINNYKNPKLTRMLTFKFYMPKKATELKHLQCLEEELKPLEEVLNLAQGSGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 100 - protein, 321 aa, Artificial Sequence
  Description of Artificial Sequence: Synthetic polypeptide
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCAGGSGGITCPPPMSVEHADIWVKSYSLYSRERYICNSGFKRKAGTSSLTECVLNKATNVAHWTTPSLKCIRDGGSELEEKNIKEFLQSFVHIVQMFINGGGSNWVNVISDLKKIEDLIQSMHIDATLYTESDVHPSCKVTAMKCFLLELQVISLESGDASIHDTVENLIILANNSLSSNGNVTESGCKEC

SEQ ID NO: 101 - protein, 438 aa, Artificial Sequence
  Description of Artificial Sequence: Synthetic polypeptide
SKSFQLEDAENFISNIRVTVVKLKGSDNTFECQFDDESATVVDFLRRWIAFCQSIISTSPQGGSSSTQQQQQHLEQLLMDLQELLSRMENYRNLKLPRMLTFKFYLPKQATELKDLQCLEDELGPLRHVLDLTQGSGGGSELCLYDPPEVPNATFKALSYKNGTILNCECKRGFRRLKELVYMRCLGNSWSSNCQCTSNSHDKSRKQVTAQLEHQKEQQTTTDMQKPTQSMHQENLTGHCREPPPWKHEDSKRIYHFVEGQSVHYECIPGYKALQRGPAISICKMKCGKTGWTQPQLTCVDGGSGGGSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDC

SEQ ID NO: 102 - protein, 321 aa, Artificial Sequence
  Description of Artificial Sequence: Synthetic polypeptide
GSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCGGSGGTTCPPPVSIEHADIRVKNYSVNSRERYVCNSGFKRKAGTSTLIECVINKNTNVAHWTTPSLKCIRDGGSELEEKTFTEFLQSFIRIVQMFINGGGSNWIDVRYDLEKIESLIQSIHIDTTLYTDSDFHPSCKVTAMNCFLLELQVILHEYSNMTLNETVRNVLYLANSTLSSNKNVAESGCKEC

SEQ ID NO: 103 - protein, 132 aa, Homo sapiens
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 104 - protein, 132 aa, Mus musculus
GSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDC

SEQ ID NO: 105 - protein, 438 aa, Artificial Sequence
  Description of Artificial Sequence: Synthetic polypeptide
GSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCGGSGGSKSFQLEDAENFISNIRVTVVKLKGSDNTFECQFDDESATVVDFLRRWIAFCQSIISTSPQGGSSSTQQQQQHLEQLLMDLQELLSRMENYRNLKLPRMLTFKFYLPKQATELKDLQCLEDELGPLRHVLDLTQGSGGGSELCLYDPPEVPNATFKALSYKNGTILNCECKRGFRRLKELVYMRCLGNSWSSNCQCTSNSHDKSRKQVTAQLEHQKEQQTTTDMQKPTQSMHQENLTGHCREPPPWKHEDSKRIYHFVEGQSVHYECIPGYKALQRGPAISICKMKCGKTGWTQPQLTCVD

SEQ ID NO: 106 - protein, 677 aa, Artificial Sequence
  Description of Artificial Sequence: Synthetic polypeptide
SKNFHLRPRDLISNINVIVLELKGSETTFMCEYADETATIVEFLNRWITFSQSIISTLTGGSSSTKKTQLQLEHLLLDLQMILNGINNYKNPKLTRMLTFKFYMPKKATELKHLQCLEEELKPLEEVLNLAQGSGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 107 - protein, 555 aa, Artificial Sequence
  Description of Artificial Sequence: Synthetic polypeptide
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCAGGSGGEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSITCPPPMSVEHADIWVKSYSLYSRERYICNSGFKRKAGTSSLTECVLNKATNVAHWTTPSLKCIRDGGSELEEKNIKEFLQSFVHIVQMFINGGGSNWVNVISDLKKIEDLIQSMHIDATLYTESDVHPSCKVTAMKCFLLELQVISLESGDASIHDTVENLIILANNSLSSNGNVTESGCKEC

SEQ ID NO: 108 - protein, 668 aa, Artificial Sequence
  Description of Artificial Sequence: Synthetic polypeptide
SKSFQLEDAENFISNIRVTVVKLKGSDNTFECQFDDESATVVDFLRRWIAFCQSIISTSPQGGSSSTQQQQQHLEQLLMDLQELLSRMENYRNLKLPRMLTFKFYLPKQATELKDLQCLEDELGPLRHVLDLTQGSGGGSELCLYDPPEVPNATFKALSYKNGTILNCECKRGFRRLKELVYMRCLGNSWSSNCQCTSNSHDKSRKQVTAQLEHQKEQQTTTDMQKPTQSMHQENLTGHCREPPPWKHEDSKRIYHFVEGQSVHYECIPGYKALQRGPAISICKMKCGKTGWTQPQLTCVDGSVPRDSGCKPCICTVPEVSSVFIFPPKPKDVLTITLTPKVTCVVVAISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGKGGSGGSGSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDC

SEQ ID NO: 109 - protein, 551 aa, Artificial Sequence
  Description of Artificial Sequence: Synthetic polypeptide
GSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCGGSGGVPRDSGCKPCICTVPEVSSVFIFPPKPKDVLTITLTPKVTCVVVAISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGKGGSTTCPPPVSIEHADIRVKNYSVNSRERYVCNSGFKRKAGTSTLIECVINKNTNVAHWTTPSLKCIRDGGSELEEKTFTEFLQSFIRIVQMFINGGGSNWIDVRYDLEKIESLIQSIHIDTTLYTDSDFHPSCKVTAMNCFLLELQVILHEYSNMTLNETVRNVLYLANSTLSSNKNVAESGCKEC

SEQ ID NO: 110 - protein, 440 aa, Artificial Sequence
  Description of Artificial Sequence: Synthetic polypeptide
SKNFHLRPRDLISNINVIVLELKGSETTFMCEYADETATIVEFLNRWITFSQSIISTLTGGSSSTKKTQLQLEHLLLDLQMILNGINNYKNPKLTRMLTFKFYMPKKATELKHLQCLEEELKPLEEVLNLAQGSGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGSGGSNELHQVPSNCDCLNGGTCVSYKYFSNIHRCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 111 - protein, 357 aa, Artificial Sequence
  Description of Artificial Sequence: Synthetic polypeptide
SKNFHLRPRDLISNINVIVLELKGSETTFMCEYADETATIVEFLNRWITFSQSIISTLTGGSSSTKKTQLQLEHLLLDLQMILNGINNYKNPKLTRMLTFKFYMPKKATELKHLQCLEEELKPLEEVLNLAQGSGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGSGGGGSGGAESTYHHLSLGYMYTLNGGSHHHHHHGGSGLNDIFEAQKIEWHE

SEQ ID NO: 112 - protein, 330 aa, Artificial Sequence
  Description of Artificial Sequence: Synthetic polypeptide
SKNFHLRPRDLISNINVIVLELKGSETTFMCEYADETATIVEFLNRWITFSQSIISTLTGGSSSTKKTQLQLEHLLLDLQMILNGINNYKNPKLTRMLTFKFYMPKKATELKHLQCLEEELKPLEEVLNLAQGSGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGSGGGGSGGNYHYLESSMTALYTLGH

SEQ ID NO: 113 - protein, 330 aa, Artificial Sequence
  Description of Artificial Sequence: Synthetic polypeptide
SKNFHLRPRDLISNINVIVLELKGSETTFMCEYADETATIVEFLNRWITFSQSIISTLTGGSSSTKKTQLQLEHLLLDLQMILNGINNYKNPKLTRMLTFKFYMPKKATELKHLQCLEEELKPLEEVLNLAQGSGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGSGGGGSGGPRYQHIGLVAMFRQNTG

SEQ ID NO: 114 - protein, 330 aa, Artificial Sequence
  Description of Artificial Sequence: Synthetic polypeptide
SKNFHLRPRDLISNINVIVLELKGSETTFMCEYADETATIVEFLNRWITFSQSIISTLTGGSSSTKKTQLQLEHLLLDLQMILNGINNYKNPKLTRMLTFKFYMPKKATELKHLQCLEEELKPLEEVLNLAQGSGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGSGGGGSGGHQIPGAYRGVNQRFTML

SEQ ID NO: 115 - protein, 224 aa, Artificial Sequence
  Description of Artificial Sequence: Synthetic polypeptide
DIRRADIVMTQTTLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 116 - protein, 447 aa, Artificial Sequence
  Description of Artificial Sequence: Synthetic polypeptide
EAKLQESGPVLVKPGASVKMSCKASGYTFTDYYMNWVKQSHGKSLEWIGVINPYNGDTSYNQKFKGKATLTVDKSSSTAYMELNSLTSEDSAVYYCARYYGSWFAYWGQGTLITVSTAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 117 - protein, 585 aa, Artificial Sequence
  Description of Artificial Sequence: Synthetic polypeptide
EAKLQESGPVLVKPGASVKMSCKASGYTFTDYYMNWVKQSHGKSLEWIGVINPYNGDTSYNQKFKGKATLTVDKSSSTAYMELNSLTSEDSAVYYCARYYGSWFAYWGQGTLITVSTAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKGGSGGSGSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDC

SEQ ID NO: 118 - protein, 214 aa, Artificial Sequence
  Description of Artificial Sequence: Synthetic polypeptide
YELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 119 - protein, 457 aa, Artificial Sequence
  Description of Artificial Sequence: Synthetic polypeptide
RLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSATTTAPSVYPLAPACDSTTSTTDTVTLGCLVKGYFPEPVTVSWNSGALTSGVHTFPSVLHSGLYSLSSSVTVPSSTWPKQPITCNVAHPASSTKVDKKIEPRTDTDTCPNPPDPCPTCPTPDLLGGPSVFIFPPKPKDVLMISLTPKITCVVVDVSEEEPDVQFNWYVNNVEDKTAQTETRQRQYNSTYRVVSVLPIKHQDWMSGKVFKCKVNNNALPSPIEKTISKPRGQVRVPQIYTFPPPIEQTVKKDVSVTCLVTGFLPQDIHVEWESNGQPQPEQNYKNTQPVLDSDGSYFLYSKLNVPKSRWDQGDSFTCSVIHEALHNHHMTKTISRSLGN

SEQ ID NO: 120 - protein, 595 aa, Artificial Sequence
  Description of Artificial Sequence: Synthetic polypeptide
RLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSATTTAPSVYPLAPACDSTTSTTDTVTLGCLVKGYFPEPVTVSWNSGALTSGVHTFPSVLHSGLYSLSSSVTVPSSTWPKQPITCNVAHPASSTKVDKKIEPRTDTDTCPNPPDPCPTCPTPDLLGGPSVFIFPPKPKDVLMISLTPKITCVVVDVSEEEPDVQFNWYVNNVEDKTAQTETRQRQYNSTYRVVSVLPIKHQDWMSGKVFKCKVNNNALPSPIEKTISKPRGQVRVPQIYTFPPPIEQTVKKDVSVTCLVTGFLPQDIHVEWESNGQPQPEQNYKNTQPVLDSDGSYFLYSKLNVPKSRWDQGDSFTCSVIHEALHNHHMTKTISRSLGNGGSGGSGSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDC

SEQ ID NO: 121 - protein, 594 aa, Artificial Sequence
  Description of Artificial Sequence: Synthetic polypeptide
GSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCGGSGGRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSATTTAPSVYPLAPACDSTTSTTDTVTLGCLVKGYFPEPVTVSWNSGALTSGVHTFPSVLHSGLYSLSSSVTVPSSTWPKQPITCNVAHPASSTKVDKKIEPRTDTDTCPNPPDPCPTCPTPDLLGGPSVFIFPPKPKDVLMISLTPKITCVVVDVSEEEPDVQFNWYVNNVEDKTAQTETRQRQYNSTYRVVSVLPIKHQDWMSGKVFKCKVNNNALPSPIEKTISKPRGQVRVPQIYTFPPPIEQTVKKDVSVTCLVTGFLPQDIHVEWESNGQPQPEQNYKNTQPVLDSDGSYFLYSKLNVPKSRWDQGDSFTCSVIHEALHNHHMTKTISRSLGN

SEQ ID NO: 122 - protein, 287 aa, Homo sapiens
MQIPQAPWPVVWAVLQLGWRPGWFLDSPDRPWNPPTFSPALLVVTEGDNTFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 123 - protein, 287 aa, Artificial Sequence
  Description of Artificial Sequence: Synthetic polypeptide
SNELHQVPSNCDCLNGGTCVSYKYFSNIHRCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCAGGSGGPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLV

SEQ ID NO: 124 - protein, 292 aa, Artificial Sequence
  Description of Artificial Sequence: Synthetic polypeptide
SNELHQVPSNCDCLNGGTCVSYKYFSNIHRCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCAGGSGGGGSGGPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLV

SEQ ID NO: 125 - protein, 287 aa, Artificial Sequence
  Description of Artificial Sequence: Synthetic polypeptide
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVGGSGGSNELHQVPSNCDCLNGGTCVSYKYFSNIHRCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 126 - protein, 155 aa, Artificial Sequence
  Description of Artificial Sequence: Synthetic polypeptide
PSPRPAGQFQTLVGGSGGGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 127 - protein, 286 aa, Artificial Sequence
  Description of Artificial Sequence: Synthetic polypeptide
GSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCGGSGGAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQ

SEQ ID NO: 128 - protein, 251 aa, Artificial Sequence
  Description of Artificial Sequence: Synthetic polypeptide
GSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCGGSGGNWIDVRYDLEKIESLIQSIHIDTTLYTDSDFHPSCKVTAMNCFLLELQVILHEYSNMTLNETVRNVLYLANSTLSSNKNVAESGCKECEELEEKTFTEFLQSFIRIVQMFINTS

SEQ ID NO: 129 - protein, 558 aa, Artificial Sequence
  Description of Artificial Sequence: Synthetic polypeptide
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSGREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSGREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 130 - protein, 558 aa, Artificial Sequence; identical to SEQ ID NO: 129
  Description of Artificial Sequence: Synthetic polypeptide

SEQ ID NO: 131 - protein, 695 aa, Artificial Sequence
  Description of Artificial Sequence: Synthetic polypeptide
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCAGGSGGREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSGREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSGREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 132 - protein, 695 aa, Artificial Sequence
  Description of Artificial Sequence: Synthetic polypeptide
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSGREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSGREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 133 - protein, 777 aa, Artificial Sequence
  Description of Artificial Sequence: Synthetic polypeptide
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGGGGSGGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 134 - protein, 768 aa, Artificial Sequence
  Description of Artificial Sequence: Synthetic polypeptide
LHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGGGGSGGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHN

SEQ ID NO: 135 - protein, 719 aa, Artificial Sequence
  Description of Artificial Sequence: Synthetic polypeptide
QRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGGGGSGGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHN

SEQ ID NO: 136 - protein, 927 aa, Artificial Sequence
  Description of Artificial Sequence: Synthetic polypeptide
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNGGGSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 137 - protein, 465 aa, Artificial Sequence
  Description of Artificial Sequence: Synthetic polypeptide
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNGGGSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNGGSGGGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 138 - protein, 264 aa, Artificial Sequence
  Description of Artificial Sequence: Synthetic polypeptide
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQEGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 139 - protein, 197 aa, Homo sapiens; identical to SEQ ID NO: 81

SEQ ID NO: 140 - protein, 306 aa, Homo sapiens; identical to SEQ ID NO: 84

SEQ ID NO: 141 - protein, 657 aa, Artificial Sequence
  Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGSGGGSGGGSSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 142 - protein, 448 aa, Artificial Sequence
  Description of Artificial Sequence: Synthetic polypeptide
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCAGGSGGGGSGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 143 - protein, 340 aa, Artificial Sequence
  Description of Artificial Sequence: Synthetic polypeptide
RNLPVATPDPGMFPCLHHSQNLLRAVSNMLQKARQTLEFYPCTEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGSGGGSGGGSSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 144 - protein, 512 aa, Artificial Sequence
  Description of Artificial Sequence: Synthetic polypeptide
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCAGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGSGGGSGGGSSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCAGGSGGHHHHHHGGSGLNDIFEAQKIEWHE

SEQ ID NO: 145 - protein, 1049 aa, Artificial Sequence
  Description of Artificial Sequence: Synthetic polypeptide
RGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQGLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVGSKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDCLSVFLNQLCVLHEKTPVSDRVTKCCTESLVNGRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGSGGGGSGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 146 - protein, 273 aa, Artificial Sequence
  Description of Artificial Sequence: Synthetic polypeptide
QNQWLQDMTTHLILRSFKEFLQSSLRALRQMSGGSGGGSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQASELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISG

SEQ ID NO: 147 - protein, 415 aa, Artificial Sequence
  Description of Artificial Sequence: Synthetic polypeptide
QNQWLQDMTTHLILRSFKEFLQSSLRALRQMSGGSGGGSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQASELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGGGSGGGGSGGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCA

SEQ ID NO: 148 - protein, 25 aa, Artificial Sequence
  Description of Artificial Sequence: Synthetic peptide
  SITE (1)..(25): This sequence may encompass 1-5 "Gly Gly Gly Gly Ser" repeating units
GGGGSGGGGSGGGGSGGGGSGGGGS

SEQ ID NO: 149 - protein, 15 aa, Artificial Sequence
  Description of Artificial Sequence: Synthetic peptide
GGGGSGGGGSGGGGS

SEQ ID NO: 150 - protein, 28 aa, Artificial Sequence
  Description of Artificial Sequence: Synthetic peptide
GGSGGGGSGGGSGGGGSGGGGSGGGSGG

SEQ ID NO: 151 - protein, 4 aa, Artificial Sequence
  Description of Artificial Sequence: Synthetic peptide
GGGS

SEQ ID NO: 152 - protein, 5 aa, Artificial Sequence
  Description of Artificial Sequence: Synthetic peptide
GGGGS

SEQ ID NO: 153 - protein, 7 aa, Artificial Sequence
  Description of Artificial Sequence: Synthetic peptide
SGGSGGG

SEQ ID NO: 154 - protein, 7 aa, Artificial Sequence
  Description of Artificial Sequence: Synthetic peptide
GGSGGSG

SEQ ID NO: 155 - protein, 5 aa, Artificial Sequence
  Description of Artificial Sequence: Synthetic peptide
GGGGS

SEQ ID NO: 156 - protein, 10 aa, Artificial Sequence
  Description of Artificial Sequence: Synthetic peptide
GGSGGGGSGG

SEQ ID NO: 157 - protein, 17 aa, Artificial Sequence
  Description of Artificial Sequence: Synthetic peptide
PRYQHIGLVAMFRQNTG

SEQ ID NO: 158 - protein, 17 aa, Artificial Sequence
  Description of Artificial Sequence: Synthetic peptide
AESTYHHLSLGYMYTLN

SEQ ID NO: 159 - protein, 214 aa, Artificial Sequence
  Description of Artificial Sequence: Synthetic polypeptide
EIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 160 - protein, 214 aa, Artificial Sequence
  Description of Artificial Sequence: Synthetic polypeptide
QIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 161 - protein, 214 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 162 - protein, 214 aa, Artificial Sequence
  Description of Artificial Sequence: Synthetic polypeptide
DIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 163 - protein, 214 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 164 - protein, 215 aa, Artificial Sequence
  Description of Artificial Sequence: Synthetic polypeptide
QIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 165 - protein, 981 aa, Artificial Sequence
  Description of Artificial Sequence: Synthetic polypeptide
EVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 166 - protein, 773 aa, Artificial Sequence
  Description of Artificial Sequence: Synthetic polypeptide
EVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGSGGHHHHHHGGSGLNDIFEAQKIEWHE

SEQ ID NO: 167 - protein, 971 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 168 - protein, 773 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGSGGHHHHHHGGSGLNDIFEAQKIEWHE

SEQ ID NO: 169 - protein, 764 aa, Artificial Sequence
  Description of Artificial Sequence: Synthetic polypeptide
EVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 170 - protein, 564 aa, Artificial Sequence
  Description of Artificial Sequence: Synthetic polypeptide
EVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 171 - protein, 583 aa, Artificial Sequence
  Description of Artificial Sequence: Synthetic polypeptide
EVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 172 - protein, 583 aa, Artificial Sequence
  Description of Artificial Sequence: Synthetic polypeptide
QIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSGGGGSEVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 173 - protein, 463 aa, Artificial Sequence
  Description of Artificial Sequence: Synthetic polypeptide
EVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - protein, 482 aa, Artificial Sequence
  Description of Artificial Sequence: Synthetic polypeptide
EVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 175 - protein, 482 aa, Artificial Sequence
  Description of Artificial Sequence: Synthetic polypeptide
QIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSGGGGSEVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - protein, 742 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSEVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGSGGGGSGGGSGGGGSGGGGSGGGSGGEVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGSGLNDIFEAQKIEWHEGGSHHHHHH

SEQ ID NO: 177 - protein, 742 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSGGGGSEVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSGGSGGGGSGGGSGGGGSGGGGSGGGSGGQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSGGGGSEVQLVQSGAEVKKPGATVKISCTASGFNIKDEYINWVKQRPGKGLEWIGWIDPENGDTEYASKFQGRVTITADTSTDTAYLELSSLRSEDTAVYYCTGGNYVGWFPYWGQGTLVTVSSGGSGLNDIFEAQKIEWHEGGSHHHHHH

SEQ ID NO: 178 - protein, 764 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 179 - protein, 537 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 180 - protein, 583 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSEIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 181 - protein, 583 aa, Artificial Sequence
  Description of Artificial Sequence: Synthetic polypeptide
EIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKGGGGSGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 182 - protein, 463 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 482 aa, Artificial Sequence
  Description of Artificial Sequence: Synthetic polypeptide
EIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKGGGGSGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - protein, 742 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSEIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKGGGGSGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGSGGGGSGGGSGGGGSGGGGSGGGSGGEIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKGGGGSGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGSGLNDIFEAQKIEWHEGGSHHHHHH

SEQ ID NO: 185 - protein, 583 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 186 - protein, 583 aa, Artificial Sequence
  Description of Artificial Sequence: Synthetic polypeptide
QIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 187 - protein, 482 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - protein, 482 aa, Artificial Sequence
  Description of Artificial Sequence: Synthetic polypeptide
QIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 189 - protein, 715 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGSGGGGSGGGSGGGGSGGGGSGGGSGGEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIK

SEQ ID NO: 190 - protein, 742 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGSGGGGSGGGSGGGGSGGGGSGGGSGGQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGGGSGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGSGLNDIFEAQKIEWHEGGSHHHHHH

SEQ ID NO: 191 - protein, 742 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSEIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKGGSGGGGSGGGSGGGGSGGGGSGGGSGGEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSEIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKGGSGLNDIFEAQKIEWHEGGSHHHHHH

SEQ ID NO: 192 - protein, 482 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSEIVLTQSPATLSLSPGERATLSCSASSSVSYMHWYQQKPGTSPRRWIYDTSKLASGVPARFSGSGSGTDFTLTISSLEPEDFAVYYCQQWSSNPPYTFGQGTKLEIKGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 193 - protein, 760 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 194 - protein, 533 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 195 - protein, 459 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - protein, 579 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 197 - protein, 579 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 198 - protein, 478 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 199 - protein, 478 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 734 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKGGSGGGGSGGGSGGGGSGGGGSGGGSGGQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKGGSGLNDIFEAQKIEWHEGGSHHHHHH

SEQ ID NO: 201 - protein, 734 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSDIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGSGGGGSGGGSGGGGSGGGGSGGGSGGDIQMTQSPSSLSASVGDTVTITCRTSENIYSNLAWYQQKPGKSPQLLVYAATNLADGVPSRFSGSGSGTQYTLKISSLQPEDFATYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGSGLNDIFEAQKIEWHEGGSHHHHHH

SEQ ID NO: 202 - protein, 579 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 203 - protein, 579 aa, Artificial Sequence
  Description of Artificial Sequence: Synthetic polypeptide
DIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 204 - protein, 478 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 478 aa, Artificial Sequence
  Description of Artificial Sequence: Synthetic polypeptide
DIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 734 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKGGSGGGGSGGGSGGGGSGGGGSGGGSGGQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKGGSGLNDIFEAQKIEWHEGGSHHHHHH

SEQ ID NO: 207 - protein, 734 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSDIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGSGGGGSGGGSGGGGSGGGGSGGGSGGDIQMTQSPSSLSASVGDRVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGSGLNDIFEAQKIEWHEGGSHHHHHH

SEQ ID NO: 208 - protein, 579 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 209 - protein, 579 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 210 - protein, 478 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 211 - protein, 478 aa, Artificial Sequence
  Description of Artificial Sequence: Synthetic polypeptide
DIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - protein, 734 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGSGGGGSGGGSGGGGSGGGGSGGGSGGQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGGGSGGGGSGGGGSDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGSGLNDIFEAQKIEWHEGGSHHHHHH

SEQ ID NO: 213 - protein, 707 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGSGGGGSGGGSGGGGSGGGGSGGGSGGDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSS

SEQ ID NO: 214 - protein, 967 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 215 - protein, 769 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGSGGHHHHHHGGSGLNDIFEAQKIEWHE

SEQ ID NO: 216 - protein, 765 aa, Artificial Sequence
  Description of Artificial Sequence: Synthetic polypeptide
QVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 217 - protein, 565 aa, Artificial Sequence
  Description of Artificial Sequence: Synthetic polypeptide
QVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 218 - protein, 585 aa, Artificial Sequence
  Description of Artificial Sequence: Synthetic polypeptide
QVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSGGGGSGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 219 - protein, 585 aa, Artificial Sequence
  Description of Artificial Sequence: Synthetic polypeptide
QIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSGGGGSQVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 220 - protein, 464 aa, Artificial Sequence
  Description of Artificial Sequence: Synthetic polypeptide
QVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - protein, 484 aa, Artificial Sequence
  Description of Artificial Sequence: Synthetic polypeptide
QVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSGGGGSGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - protein, 484 aa, Artificial Sequence
  Description of Artificial Sequence: Synthetic polypeptide
QIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSGGGGSQVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 223 - protein, 746 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSQVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSGGGGSGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGSGGGGSGGGSGGGGSGGGGSGGGSGGQVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSGGGGSGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGSGLNDIFEAQKIEWHEGGSHHHHHH

SEQ ID NO: 224 - protein, 746 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSGGGGSQVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSGGSGGGGSGGGSGGGGSGGGGSGGGSGGQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSGGGGSQVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSGGSGLNDIFEAQKIEWHEGGSHHHHHH

SEQ ID NO: 225 - protein, 972 aa, Artificial Sequence
  Description of Artificial Sequence: Synthetic polypeptide
QVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 226 - protein, 774 aa, Artificial Sequence
  Description of Artificial Sequence: Synthetic polypeptide
QVQLVQSGAEVAKPGASVNLNCKASGYTFTSYGISWVRQRTGQGLEWIGEIYPRSGNTYYNEKFKGKVTLTTDKSTRTAYMELRSLTSEDTAVYYCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGSGGHHHHHHGGSGLNDIFEAQKIEWHE

SEQ ID NO: 227 - protein, 765 aa, Artificial Sequence
  Description of Artificial Sequence: Synthetic polypeptide
QVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 228 - protein, 565 aa, Artificial Sequence
  Description of Artificial Sequence: Synthetic polypeptide
QVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 229 - protein, 585 aa, Artificial Sequence
  Description of Artificial Sequence: Synthetic polypeptide
QVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSGGGGSGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 230 - protein, 585 aa, Artificial Sequence
  Description of Artificial Sequence: Synthetic polypeptide
QIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSGGGGSQVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 231 - protein, 464 aa, Artificial Sequence
  Description of Artificial Sequence: Synthetic polypeptide
QVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 232 - protein, 484 aa, Artificial Sequence
  Description of Artificial Sequence: Synthetic polypeptide
QVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSGGGGSGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - protein, 484 aa, Artificial Sequence
  Description of Artificial Sequence: Synthetic polypeptide
QIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSGGGGSQVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSGGGGSGGGGSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 234 - protein, 746 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSQVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSGGGGSGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGSGGGGSGGGSGGGGSGGGGSGGGSGGQVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSGGGGSGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGSGLNDIFEAQKIEWHEGGSHHHHHH

SEQ ID NO: 235 - protein, 746 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSGGGGSQVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSGGSGGGGSGGGSGGGGSGGGGSGGGSGGQIVLTQSPATLSASPGERVTMTCSASSSVSSRYLHWYQQKSGASPRLWIYGTSNLASGVPARFSGSGPGTSYTLTISSVEPEDAATYYCQQYHSDPLTFGQGTKLELKGGGGSGGGGSGGGGSQVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSGGSGLNDIFEAQKIEWHEGGSHHHHHH

SEQ ID NO: 236 - protein, 972 aa, Artificial Sequence
  Description of Artificial Sequence: Synthetic polypeptide
QVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 237 - protein, 774 aa, Artificial Sequence
  Description of Artificial Sequence: Synthetic polypeptide
QVQLQQSGAEVAKPGASVNLNCKASGYTFTSYGISWVRQRTGQGLEWIGEIYPRSGNTYYNEKFKGKATLTADKSTRTAYMELRSLTSEDTAVYFCAGKDYGSTYADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGSGGGGSGGRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGSGGHHHHHHGGSGLNDIFEAQKIEWHE

SEQ ID NO: 238 - protein, 448 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 439 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGSGGGGSGEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 240 - protein, 15 aa, Artificial Sequence
  Description of Artificial Sequence: Synthetic peptide
GLNDIFEAQKIEWHE

SEQ ID NO: 241 - protein, 6 aa, Artificial Sequence
  Description of Artificial Sequence: Synthetic peptide
HHHHHH

SEQ ID NO: 242 - protein, 6 aa, Artificial Sequence
  Description of Artificial Sequence: Synthetic peptide
GGSGGG

SEQ ID NO: 243 - protein, 27 aa, Artificial Sequence
  Description of Artificial Sequence: Synthetic peptide
GGSHHHHHHGGSGLNDIFEAQKIEWHE

SEQ ID NO: 244 - protein, 29 aa, Artificial Sequence
  Description of Artificial Sequence: Synthetic peptide
GGSGGHHHHHHGGSGLNDIFEAQKIEWHE

SEQ ID NO: 245 - protein, 27 aa, Artificial Sequence
  Description of Artificial Sequence: Synthetic peptide
GGSGLNDIFEAQKIEWHEGGSHHHHHH

SEQ ID NO: 246 - protein, 10 aa, Artificial Sequence
  Description of Artificial Sequence: Synthetic peptide
GGGSGGGGSG

SEQ ID NO: 247 - protein, 20 aa, Artificial Sequence
  Description of Artificial Sequence: Synthetic peptide
  SITE (1)..(20): This sequence may encompass 1-5 "Gly Gly Gly Ser" repeating units
GGGSGGGSGGGSGGGSGGGS

SEQ ID NO: 248 - protein, 20 aa, Artificial Sequence
  Description of Artificial Sequence: Synthetic peptide
GGGGSGGGGSGGGGSGGGGS

SEQ ID NO: 249 - protein, 72 aa, Artificial Sequence
  Description of Artificial Sequence: Synthetic polypeptide
  SITE (1)..(72): This sequence may encompass 1-8 "(Gly)nSer" repeating units where n = 1-8
GGGGGGGGSGGGGGGGGSGGGGGGGGSGGGGGGGGSGGGGGGGGSGGGGGGGGSGGGGGGGGSGGGGGGGGS

SEQ ID NO: 250 - protein, 5 aa, Artificial Sequence
  Description of Artificial Sequence: Synthetic peptide
DGGGS

SEQ ID NO: 251 - protein, 5 aa, Artificial Sequence
  Description of Artificial Sequence: Synthetic peptide
TGEKP

SEQ ID NO: 252 - protein, 4 aa, Artificial Sequence
  Description of Artificial Sequence: Synthetic peptide
GGRR

SEQ ID NO: 253 - protein, 14 aa, Artificial Sequence
  Description of Artificial Sequence: Synthetic peptide
EGKSSGSGSESKVD

SEQ ID NO: 254 - protein, 18 aa, Artificial Sequence
  Description of Artificial Sequence: Synthetic peptide
KESGSVSSEQLAQFRSLD

SEQ ID NO: 255 - protein, 8 aa, Artificial Sequence
  Description of Artificial Sequence: Synthetic peptide
GGRRGGGS

SEQ ID NO: 256 - protein, 9 aa, Artificial Sequence
  Description of Artificial Sequence: Synthetic peptide
LRQRDGERP

SEQ ID NO: 257 - protein, 12 aa, Artificial Sequence
  Description of Artificial Sequence: Synthetic peptide
LRQKDGGGSERP

SEQ ID NO: 258 - protein, 18 aa, Artificial Sequence
  Description of Artificial Sequence: Synthetic peptide
GSTSGSGKPGSGEGSTKG

SEQ ID NO: 259 - protein, 308 aa, Artificial Sequence
  Description of Artificial Sequence: Synthetic polypeptide
LRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRGGSHHHHHHGGSGLNDIFEAQKIEWHE

SEQ ID NO: 260 - protein, 301 aa, Artificial Sequence
  Description of Artificial Sequence: Synthetic polypeptide
LQCMQCESNQSCLVEECALGQDLCRTTVLREWQDDRELEVVTRGCAHSEKTNRTMSYRMGSMIISLTETVCATNLCNRPRPGARGRAFPQGRYLECASCTSLDQSCERGREQSLQCRYPTEHCIEVVTLQSTERSLKDEDYTRGCGSLPGCPGTAGFHSNQTFHFLKCCNYTHCNGGPVLDLQSFPPNGFQCYSCEGNNTLGCSSEEASLINCRGPMNQCLVATGLDVLGNRSYTVRGCATASWCQGSHVADSFPTHLNVSVSCCHGSGCNSPTGGSHHHHHHGGSGLNDIFEAQKIEWHE

SEQ ID NO: 261 - protein, 179 aa, Artificial Sequence
  Description of Artificial Sequence: Synthetic polypeptide
MYRMQLLSCIALSLALVTNSSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCAGGSHHHHHHGGSGLNDIFEAQKIEWHE

SEQ ID NO: 262 - protein, 179 aa, Artificial Sequence
  Description of Artificial Sequence: Synthetic polypeptide
MYRMQLLSCIALSLALVTNSGSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCGGSHHHHHHGGSGLNDIFEAQKIEWHE

SEQ ID NO: 263 - protein, 250 aa, Artificial Sequence
  Description of Artificial Sequence: Synthetic polypeptide
MYRMQLLSCIALSLALVTNSGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRGGSHHHHHHGGSGLNDIFEAQKIEWHE

SEQ ID NO: 264 - protein, 150 aa, Artificial Sequence
  Description of Artificial Sequence: Synthetic polypeptide
MYRMQLLSCIALSLALVTNSGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRGGSHHHHHHGGSGLNDIFEAQKIEWHE

SEQ ID NO: 265 - protein, 564 aa, Artificial Sequence
  Description of Artificial Sequence: Synthetic polypeptide
EVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 266 - protein, 742 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGSGGGGSGGGSGGGGSGGGGSGGGSGGEVQLQQSGAEVKKPGATVKLSCTASGFNIKDEYINWVKQRPGQGLEWIGWIDPENGDTEYASKFQGRATITADTSTDTAYLELSSLRSEDTAVYYCTGGNYVGWFPYWGQGTLVTVSSGGGGSGGGGSGGGGSQIVLTQSPATLSASPGERVTMSCSASSSVSYMHWYQQKPGTSPRRWLYDTSKLASGVPARFSGSGSGTDYTLTISSLEPEDFATYYCQQWSSNPPYTFGQGTKLEIKGGSGLNDIFEAQKIEWHEGGSHHHHHH

SEQ ID NO: 267 - protein, 560 aa, Artificial Sequence
  Description of Artificial Sequence: Synthetic polypeptide
QIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSASPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGSGLNDIFEAQKIEWHEGGSHHHHHH

SEQ ID NO: 268 - protein, 734 aa, Artificial Sequence
  Description of Artificial Sequence: Synthetic polypeptide
RNLPVATPDPGMFPCLHHSQNLLRAVDNMLQKARQTLEFYPCTSEEIDHEDITKDKTSTVEACLPLELTKNESKLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTINRVMSYLNASGGGGSGGGGSDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGSGGGGSGGGSGGGGSGGGGSGGGSGGDIQMTQSPSSLSASVGDTVTITCRTSENIYSNLAWYQQKPGKSPQLLVYAATNLADGVPSRFSGSGSGTDYTLTISSLQPEDFGTYYCQHFWGTPWTFGGGTKVEIKGGGGSGGGGSGGGGSQIQLVQSGSELKKPGASVKISCKASGTTFTDYGMNWVKQSPGKGLKWMGWINTNTGEPTYAEDFKGRFVFSLDTSVSTAYLQISSLKAEDTATYFCAHYSFDYWGQGTLLTVSSGGSGLNDIFEAQKIEWHEGGSHHHHHH

SEQ ID NO: 269 - protein, 40 aa, Artificial Sequence
  Description of Artificial Sequence: Synthetic polypeptide
  SITE (1)..(40): This sequence may encompass 1-10 "Gly Gly Gly Ser" repeating units
GGGSGGGSGGGSGGGSGGGSGGGSGGGSGGGSGGGSGGGS

SEQ ID NO: 270 - protein, 50 aa, Artificial Sequence
  Description of Artificial Sequence: Synthetic polypeptide
  SITE (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 271 - protein, 70 aa, Artificial Sequence
  Description of Artificial Sequence: Synthetic polypeptide
  SITE (1)..(70): This sequence may encompass 1-10 "Ser Gly Gly Ser Gly Gly Gly" repeating units
SGGSGGGSGGSGGGSGGSGGGSGGSGGGSGGSGGGSGGSGGGSGGSGGGSGGSGGGSGGSGGGSGGSGGG

SEQ ID NO: 272 - protein, 70 aa, Artificial Sequence
  Description of Artificial Sequence: Synthetic polypeptide
  SITE (1)..(70): This sequence may encompass 1-10 "Gly Gly Ser Gly Gly Ser Gly" repeating units
GGSGGSGGGSGGSGGGSGGSGGGSGGSGGGSGGSGGGSGGSGGGSGGSGGGSGGSGGGSGGSGGGSGGSG

SEQ ID NO: 273 - protein, 20 aa, Artificial Sequence
  Description of Artificial Sequence: Synthetic peptide
  SITE (1)..(20): This sequence may encompass 2 or 4 "Gly Gly Gly Gly Ser" repeating units
GGGGSGGGGSGGGGSGGGGS

What is claimed is:

1. A kit comprising a first pharmaceutical composition comprising a first fusion protein and a second pharmaceutical composition comprising a second fusion protein, wherein:
   (a) the first fusion protein comprises:
       (i) an antigen binding domain that binds specifically to a first epitope on urokinase plasminogen activator receptor (uPAR) comprising a heavy chain variable domain comprising a CDR1, a CDR2, and a CDR3 of SEQ ID NOs: 41, 20, and 21, respectively, and a light chain variable domain comprising a light chain variable domain comprising a CDR1, a CDR2, and a CDR3 of SEQ ID NOs: 22-24, respectively; and
       (ii) a IL-12 p35 subunit comprising SEQ ID NO: 81, optionally wherein the IL-12 p35 subunit comprises one or more of the following amino acid substitutions in SEQ ID NO: 81 selected from the group of: M12S, S27D, N28R, Q35E, F39D, F39H, S44K, C74K, C74D, C74W, C74Y, C74Q, M111F, M111W, V114I, M119L, M145L, F150Y, L161D, L161Q, and D188N; and
   (b) the second fusion protein comprises:
       (i) an antigen binding domain that binds specifically to a second epitope on uPAR comprising a heavy chain variable domain comprising a CDR1, a CDR2, and a CDR3 of SEQ ID NOs: 3-5, respectively, and a light chain variable domain comprising a light chain variable domain comprising a CDR1, a CDR2, and a CDR3 of SEQ ID NOs: 6-8, respectively; and
       (ii) a IL-12 p40 subunit comprising SEQ ID NO: 84, optionally wherein the IL-12 p40 subunit comprises one or two of the following amino acid substitutions in SEQ ID NO: 84: C177S, C177F, C177M, C177H, C177I, C177Q, and C252S.

2. The kit of claim 1, wherein the antigen binding domain that binds specifically to the first epitope on uPAR comprises a heavy chain variable domain comprising SEQ ID NO: 37 and a light chain variable domain comprising SEQ ID NO: 40.

3. The kit of claim 1, wherein the antigen binding domain that binds specifically to the second epitope on uPAR comprises a heavy chain variable domain comprising SEQ ID NO: 34 and a light chain variable domain comprising SEQ ID NO: 35.

4. The kit of claim 3, wherein the light chain variable domain of the antigen binding domain that binds specifically to the second epitope on uPAR further comprises a light chain constant domain.

5. The kit of claim 4, wherein the light chain constant domain comprises a lambda light chain constant domain.

6. The kit of claim 1, wherein the IL-12 p35 subunit comprises the following amino acid substitutions in SEQ ID NO: 81: S27D, C74K, and D188N.

7. The kit of claim 6, wherein the IL-12 p35 subunit comprises a sequence of SEQ ID NO: 83.

8. The kit of claim 1, wherein the IL-12 p40 subunit comprises the following amino acid substitutions in SEQ ID NO: 84: C177S and C252S.

9. The kit of claim 8, wherein the IL-12 p40 subunit comprises a sequence of SEQ ID NO: 87.

10. The kit of claim 1, wherein the first fusion protein further comprises a linker disposed between the antigen binding domain that specifically binds to a first epitope on uPAR and the IL-12 p35 subunit, optionally, wherein the linker comprises (GGGGS) n (SEQ ID NO: 148), wherein N=2.

11. The kit of claim 10, wherein the first fusion protein further comprises a second antigen binding domain that specifically binds to the first epitope on uPAR.

12. The kit of claim 11, wherein the first fusion protein comprises a sequence of SEQ ID NO: 213.

13. The kit of claim 1, wherein the second fusion protein comprises a first polypeptide and a second polypeptide, wherein the first polypeptide comprises the heavy chain variable domain of the antigen binding domain that specifically binds to the second epitope on uPAR fused to the IL-12 p40 subunit, wherein a linker is disposed between the heavy chain variable domain of the antigen binding domain that specifically binds to the second epitope on uPAR and the IL-12 p40 subunit; and
   the second polypeptide comprises the light chain variable domain of the antigen binding domain that specifically binds to the second epitope on uPAR fused to a lambda light chain constant domain.

14. The kit of claim 13, wherein the first polypeptide comprises a sequence of SEQ ID NO: 179 and the second polypeptide comprises a sequence of SEQ ID NO: 159.

15. The kit of claim 13, wherein the linker comprises (GGGGS)n (SEQ ID NO: 148), wherein N=2.

* * * * *